(12) United States Patent
Bermingham, Jr.

(10) Patent No.: US 7,300,759 B2
(45) Date of Patent: Nov. 27, 2007

(54) USE OF TRAMDORINS IN DIAGNOSTIC AND THERAPEUTIC METHODS

(75) Inventor: John R. Bermingham, Jr., Great Falls, MT (US)

(73) Assignee: McLaughlin Research Institute, Great Falls, MT (US)

( * ) Notice: Subject to any disclaimer, the term of this patent is extended or adjusted under 35 U.S.C. 154(b) by 230 days.

(21) Appl. No.: 10/225,810

(22) Filed: Aug. 21, 2002

(65) Prior Publication Data

US 2003/0157512 A1    Aug. 21, 2003

Related U.S. Application Data

(60) Provisional application No. 60/313,907, filed on Aug. 21, 2001.

(51) Int. Cl.
G01N 33/53 (2006.01)
C12N 1/19 (2006.01)
C07K 14/47 (2006.01)

(52) U.S. Cl. .............................. 435/7.1; 435/4; 435/6; 435/254.2; 530/350; 536/23.5

(58) Field of Classification Search ............. None
See application file for complete search history.

(56) References Cited

OTHER PUBLICATIONS

Araki et al. (2001). Identification of genes induced in peripheral nerve after injury. The Journal of Biological Chemistry. 276(36):34131-34141.*

Kubo et al. (2002). Analysis of genes induced in peripheral nerve after axotomy using cDNA microarrays. Journal of Neurochemistry. 82:1129-1136.*

Haynes et al. (1998). Proteome analysis: biological assay or data archive. Electrophoresis 19:1862-1871.*

Hu et al. (2003). Analysis of genomic and proteomic data using advanced literature mining. Journal of Proteome Research. 2:405-412.*

Chen et al. (2002). Discordant protein and mRNA expression in lung adenocarcinomas. Molecular and Cellular Proteomics. 1:304-313.*

Wells, J.A. (1990). Additivity of mutational effects in proteins. Biochemistry. 29(37):8509-8517.*

Ngo et al. (1994). Computational complexity, protein structure prediction, and the Levinthal paradox. In Merz and Le Grand (Eds.) The Protein Folding Problem and Tertiary Structure Prediction. Birkhauser:Boston, pp. 492-495.*

* cited by examiner

*Primary Examiner*—Christine J. Saoud
*Assistant Examiner*—Jon M Lockard
(74) *Attorney, Agent, or Firm*—Medlen & Carroll, LLP

(57) ABSTRACT

A family of transmembrane domain proteins, the tramdorins, has been identified in human, mouse and rat. A variety of uses for these proteins is contemplated, including but not limited to peripheral myelination, the etiology of parathyroid adenomas, and the diagnosis and treatment of Central Nervous System (CNS) and non-CNS disorders.

1 Claim, 51 Drawing Sheets
(3 of 51 Drawing Sheet(s) Filed in Color)

| | | | | | | | | |
|---|---|---|---|---|---|---|---|---|
| Mouse | TCTCTGGTCC | AAGACAGGAA | AAAACAAAAC | AAAACAAAAA | ACAGGTGTAG | CATATCCCCA | GTACCGTGTG | TGTGTGCGCG | CGGCGCCAAA GGAGATGGGG GCCATCTACA 1748 |
| Rat | TCTCTGTCC | AAGACAAGAA | AAAACA---- | ---------- | ------GACGTAC | CATATCCCCG | GCACCATGTG | CGTCTGCGC- | ---------AAA GGAGATGGGG GCCATCTACA 1699 |
| Mouse | CCGCATACAA | GGTGTAGATA | GATGGTCATT | AAAAACAAAA | GAAATGTTGG | TCGTTCTCTA | GTTTTCCACA | CTGTGAGAC | CTCACCTGTG GAAACCGCCA TCTTGTTTTT 1858 |
| Rat | CCACGTACAA | GGTGTAGATA | GATGGTCATT | AAAAACGAAA | --AATGTTGG | TCATTCTCTA | GTTTTCCACA | CTTGGAGAC | CTCGCCTGTG GAAGCCGCCA TCTTGTTTCT 1807 |
| Mouse | GTCATTTATC | TGCTAATTTC | CTGCCTTGAC | TGGAGCTATC | CAAAAAGCAA | CCACTAGGCG | GCAGCAATAG | CCAGCTTTTG | GCAGAAGTA GTCTCTGCCC GCTGAGGCTT 1968 |
| Rat | GTCATTTATC | T--AATTTC | TTACCTTGAG | TGGAGCTATG | TAAAAAGCGG | CCACTAGGAG | GCAGCAAGCG | CCAGCTTTTG | GCAGAAAGTG GTCCCTGCCA GCTCAAGTTT 1914 |
| Mouse | TGGTTATTTC | CTTTTCCTGA | CCATGATGGG | GAACACTGTG | CTCAAGGCAG | CATCAAGATG | CTCAGAAATCC | GAGGGGGCCA | CAATGCTCAG ATAAAATGTC ACCATCTATG 2078 |
| Rat | TGGTCATTTC | CTTTTCCTGA | CCATGATGGG | CATCATTGGG | CCCCACATCAG | CATTAAGATG | TCAGAAATCC | GAGGGGGCCA | CAATGCTCAG GTAAAATGTC ACCGTCTATG 2024 |
| Mouse | TTACAGATAA | GTGTGTTGAA | CTTTCTAAAC | CACTAAGTCT | TAGC-CCAAC | TCAGAAAATCC | AGCAGTGAAC | AGCAGCGACC | TAGGGTGCATG CCTATGGGGC AGGGGCAGCA 2187 |
| Rat | TTACAGATAA | ATGTGTTGAA | CTTTCTAAAC | --------T-T | TAGCTCCAAC | TCAGAAATCC | AGCAGTGAAC | AGCAGCGACC | TAGGCTCAAG TCTCTGAGCC AGGGCCAGCA 2126 |
| Mouse | GACAGAGACA | TCATTGGAGT | CGTTTTTT- | ---------- | ---------- | --ACTTCTG | AATTCTTGCA | A---TGAACA | TCTTCTGTTA CCTGTCGGGC 2260 |
| Rat | GACAGACATC | ATTTGAGTAG | TTGTTTTTG | TTTTTTTTT | GTTTTTTGT | TTTACTTCTG | AATTCTTGCA | ACAATGAACA | TCCTCTGTTA CCTATTGGAT 2236 |
| Mouse | ACCAAGCATA | ATACAGGGCT | CTTATATAAT | AGTTGGGTA | AAGGTGTTAT | AAAAACAA-- | ---------- | ---GAGCTTA | TATAACATTG TAGCTTTGTG TACCCAACAG 2355 |
| Rat | ATGAA----- | ------GGCT | CTTATATAAT | AGATTGGGTA | AAGGTGTTCT | AAAAACAAAA | CAAAACAAAA | CCACTGCCTA | TATAACATTG TGGCTTGGTG TACCAAACGG 2335 |
| Mouse | TAGAGTCTAC | GGGTCATCTC | CTGAGTCTTG | ACCTTGTAAC | TTGCCATGGT | CAACAGTAAA | AGTGTTACCA | TATGGAGAAA | AAAAAAAAAA 2445 |
| Rat | TGGAGTCTAC | AGCTCACC-C | TTGAGTCTTG | ACCTTGTAAC | TTCCTTGGCC | CAACAGTAAA | AGTGTTAC-A | AATGCCAAAA | AAAAAAA 2421 |

FIG. 2D

```
1920302: MSVTKSARSP QVATPLNLDL PESAKKLQSQ DPSPANGTSS ESSKKTKGIT GFQTLVHLVK GNMGTGILGL PLAVKNAGIL MGPLSLLVMG LIACHCMHIL 100
PHDHtm:                                                                    TTTTTT            TTTTTTTTTT TTTTTTTTTT TTTTTTTTTT
Memsat2: ++++++++++ ++++++++++ ++++++++++ ++++++++++ ++++++++++ +++IIIIXXX XXXXXXOOOO -------00 OOXXXXXXII IIIIIIIIII
TMHMM:   ++++++++++ ++++++++++ ++++++++++ ++++++++++ ++++++++++ ++++TTTTTT TTTTTTTTTT TTT-----TT TTTTTTTTTT TTTTTTTTTT
                                                                        1

1920302: VRCAQRFCHR LNKPPMDYGD TVMHGLAFSP NAWLQNHAFW GRRVVSFFLI IQEIPDASQ IVFLADNLKQ VVEAVNSTTI SCHKNETVAL TPTMDSRLYM 200
PHDHtm:  TTTTTTTTTT TTTTT                           TTTTTTTTTT TTTTT              TTTTTTTTTT                       TTT
Memsat2: I+++++++++ +++++++++ +++++++++ +++++++++ ++IIIIXXXX XXXXXXXXXX XOOOO-----                           -----OOOO
TMHMM:   T+++++++++ +++++++++ +++++++++ +++++++++ +++TTTTTT TTTTTTTTTT TTTTTT                                 -TTTTT
                                                          3

1920302: LSFLPVLGLL VFVRNLRVLT IFSLLANISM LVSLVIIAQY IIQEIPDASQ LPLVASWKTY PLFFGTAIFS PRSIGVVLPL ENKMKDARGF PTILSLGMSI 300
PHDHtm:  TTTTTTTTTT TTTTTT     TTTTTTTTTT TTTTTTTTTT                       T TTTTTTTTTT TTTTTTTTTT            TTTTTT
Memsat2: III+++++++ XXXXXXXXX  IIIIXXXXXX XXXXXXXXXX TTT-------- ---0       0 OOOXXXXXXX XXXXXXIIII ++IIIIXXXX ++IIIIIII
TMHMM:   TTT++++++T TTTTTT     TTTTTTTTTT TTTTTTTTTT TT--------- --TTT      TTT TTTTTTTTT TTTTTT++++ +TTTTTTTTT +TTTTTTTT
              4                    5                                        6

1920302: ITTLYIAIGA LGYLRFGDDI KASITLNLPN CMLYQSVKLL YVVGLLCTYA LQPFVPAEII IPLAVSQVSK RWALPVDLSI RLALVCLTCM LAILIPRLDL 400
PHDHtm:  TTTTTTTTTT TTTTT                           TTTTTTTTTT TTTTT              TTTTT       TTT       TTTTTTTTTT TTTTTTTTTT
Memsat2: XXXXXXXXXX XOOOO----             -------00 OOXXXXXXXX XXXXXXIIII I+++++++++ ++++++++++ +IIIIXXXX  +IIIXXXXX XXXXOOOO--
TMHMM:   TTTTTTTT                         --TT      TTTTTTTTTT TTTTT      T++++++++ T+++++++++ ++TTTTTTT  +TTTTTTTT TTTT------
                                                          8                                                    9

1920302: VLSLVGSVSS SALALLIPPL LEVVTVYGEG ISPLTVTKDA LISILGFMGF VVGTYQALDE LIKSGNSPAL SNSTMFIQ* 478
PHDHtm:  TTTTTTTTTT TTTTTT     TTTTT            TTTTT TTTTT     TTTTT
Memsat2: -------OOOXX -TTTTT    XXXIIIII+++ +++++++++I IIXXXXXXXX XXXXOOOO--
TMHMM:   -----TTTTT  T          TTTTTTT+++ +++++++++T TTTTTTTTTT TTTTT-----
                10                                      11
```

FIG. 3A

▲ = EXON IDENTIFIED BY HOMOLOGY TO MOUSE TRAMDORIN 1

▲ = EXON IDENTIFIED BY HOMOLOGY TO MOUSE TRAMDORIN 2

TTTAGGGTTA GATACACTGC TTATTATCAC GTGGATAAAT TTGTCTTCTT TCCTTAAGTA ACAGCGCTTT CATTTCTGGA AGGTGAGTTT AGGACCTGAA TAAGTGTTAA ATCCTCGAAAT
ATTTTCACTA AGACAGGTAG TAGTTATTCA GAAAACTTCAA AGTCTTATTG ATTGTATCCT TTTACAG|GAA GAG GAT GAA ATG GAT TCT GGC ACG
                                                                          E   E   D   E   M   D   S   G   T
ATG GTT CGA GCA GTG GGT GAT GAG GGC ATG ACT GTC CGA GTA GCC AGC ACC ATG ACT GAT GGA GCC AAT ACT ATG GAG CAC GAT GAC ACG TTG CCA
 M   V   R   A   V   G   D   E   M   G   T   V   R   V   A   S   T   M   T   D   G   A   N   T   M   E   H   D   D   T   L   P
TCA CAA CTG GGC ACC ATG GTG ATC ATG GCA GAG GAA GAG ACT ATG AAA A|GTAAG GCTCTGAGTA AATCACTGA CTTCCTAGAC CAAGCATACA
 S   Q   L   G   T   M   V   I   M   A   E   D   E   E   E   E   G   T   M   K
TATTTCAGAG AAGACAGATT CTCATGGTTC ATGCAGGCTT GTCACAACCA AAGGAGTAGA AAACTTGGAA GTTCCGGATG GGGACAGGAG GTTTGGTGAG
GGGGAAAGCT GGCTGTGGA GTCAAAGTCA AGAAAGCATC AACAGTGAGA AAGAATTTTG CTTTTGAACC AGAGCAGCCA TTTTCTCATT GAATGTTGTT ATTATTTTCC TTCCTTACCT

FIG. 11B

CTCCCCTTTT GAAACCCTTA ATAAAAACTT GCTGGTCTGA GACTTAGGTC GGCATACACGG TCTTACCGAT ATGTGATGTC ACCCCTGGCA GCCCAGCTGT AAAATTCCTC TCTTTGTACT
GTCTCTCTTT ATTTCTCAGC CAGCTGACAC TTATGGAAAA CTCTTTTCAC CTACATAAC CTACATTGAG ATACTGGGGG CAGGTTCCCC CAATATTCTG CCATGCTCGG ATTTTAATTG TAAGTGTGTT
CCCCTCTGGG GCAAGTGGAA ACCAGGTTAT CTTCTTCCAC TGCAG|GT TCC CTG GCC ATC CCC ATC CTG GGC ATG GTC CTT ACC CAG ATG AGC TTG GTG
                                                X  S   L   A   I   L   I   P   H   L   G   M   V   L   T   Q   M   S   L   V
AGC AGC AGC ACC CTG CCC CTC ATC ATC CTG TGC CTC CTG GAG ATG ACT TAC TAC TCA GAG TGC ATG AGC TCC CTC ATC ATC TTA AAG GAC GCC CTG
 S   S   S   T   L   P   L   I   I   L   C   L   L   E   M   T   T   Y   Y   S   E   C   M   S   S   L   I   I   T   K   D   A   L   tramdL
ATC AGC ATC CTG GGC TTT GTG GGA TTT CTG GTG GGG ACC TTC TAG GCCCT CCATGAGCTC AGCCAGCCTC CTCTTCCAA ACTCCACTGG CACCTTGAAA
 I   S   I   L   G   F   V   G   F   L   V   G   T   F   *
CCATTTCAACTCAACATTCCGGCTTCACTCTTCTAAACTGACATTACTAGCCTTGTTGAACAAAGATCCTTACTTAA*TTGCTAATGTGTA
TA TTTATATGGG GCCACCACAG TGTTGGGTGG
AGAGTACAGG AGTGGGTGTC AGAGGATCIG AGTTCTATTC CTGAGATCTA CCATTTACCC CCATTCAGATC TGAGTGGCCACTTCCCCCCTT
GGGAGCCTCA ACTTCACAAATTCAGTTAAG

FIG. 11C

STK4/MST-1/Krs-2 GENOMIC:     ATG AAA A|GTAAGGCTCT
                                      M  K
EST cDNA 1388139 nt 576-590: ATG AAA A|GT TCC CTG
                                        M  K   S   S   L
tramdL GENOMIC:                CCACTGCAG|GT TCC CTG
                                           X   S   L
FIG. 11D
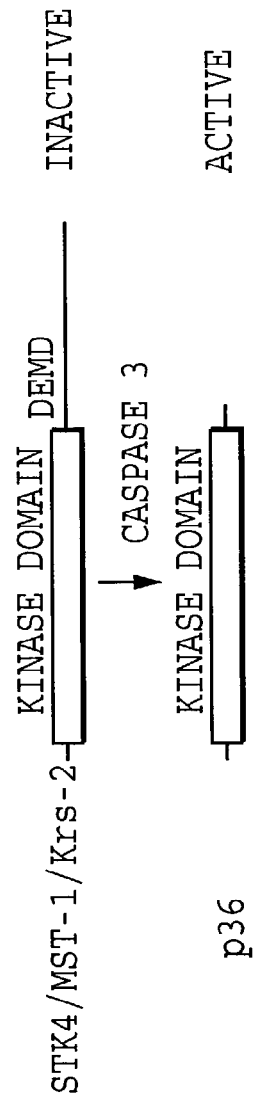
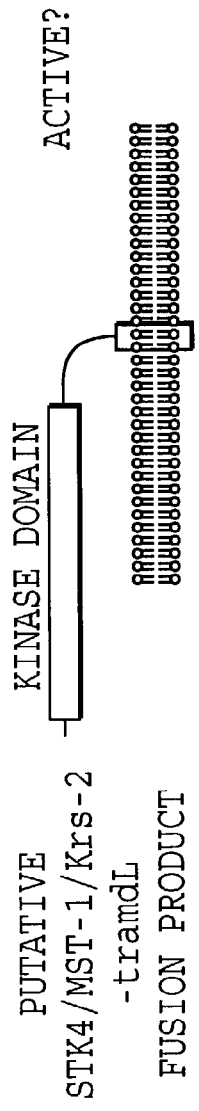
FIG. 11E

```
                        10         20         30         40         50         60
HUMAN TRAMD1  MSVTKSTEGPQGAVAIKLDMSPPESAKKLENKDSTFLDESPSESAGLKKTKGITVFQAL
HUMAN TRAMD2                                                          MMQTL
HUMAN TRAMD3  MSTQRLRNEDYHDYSSTDVSPEESPSEGLNNLS-----SPGSYQRFGQSNSTWFQTL
                        70         80         90        100        110        120
HUMAN TRAMD1  IHLVKGNMGTGILGLLGLPLAVKNAGIIMGPLSLLVMGEIACHCMHILVKCAQRFCKRLNKPF
HUMAN TRAMD2  IHLLKKCNIGTGLLGLLGLPLAIKNAGLLVGPVSLLAIGVLTVHCMVILLNCAQHLSQRLQKTF
HUMAN TRAMD3  IHLLKGNIGTGLLGLLGLPLAVKNAGIVMGPISLLLIGIVAVHCMGILVKCAHHFCRRLNKSF
                       130        140        150        160        170        180
HUMAN TRAMD1  MDYGDTVMHGLEANPNAWLQNHAHWGRHIVSFPLIITQLGFCCVYIIVFLADNLKQVVEAV
HUMAN TRAMD2  VNYGEATMYGLETCPNTWLRNHAHWGRYTVSFLLVIITQLGFCCSVYFPMFMADNLQQMVEEA
HUMAN TRAMD3  VDYGDTVMYGLESSPCSWLRNHAHWGRRVDPFLIVTQLGFCCCVYFVFLADNFKQVIEAA
                       190        200        210        220        230        240
HUMAN TRAMD1  NSTTNNCYSNETVILTPTMDSRLYMLSFLPFLVLLVLIRNLRILTIFSMLANISMLVSLV
HUMAN TRAMD2  HVTSNICQPREILTLTPILDDRFYMLILPFLILPFLVLVFIQNLKVLSVFSTLANITLGSMA
HUMAN TRAMD3  NGTTNNCHNNETVILTPTMDSRLYMLSFLPFFLVLVFIRNLRALSIFSLLANITMLVSLV
                       250        260        270        280        290        300
HUMAN TRAMD1  IIIQYITQEIPDPSRLPLVASWKTYPLFFGTAIFSFESIGVVLPLENKMKNARHFPAILS
HUMAN TRAMD2  LIFEYIMEGIPYPSNLPLMANWKTFLFFGTAIFTFEGVGMVLPLKINQMKHPQQFSFVLY
HUMAN TRAMD3  MIYQFIVQRIPDPSHLPLVAPWKTYPLFFGTAIFSFEGIGMVLPLENKMKDPRKFPLILY
```

FIG. 13A

```
                    310        320        330        340        350        360
HUMAN TRAMD1  LGMSIVTSLYIGMAALGYLRFGDDIKASISINLPNCWLYQSVKLLYIAGILCTYALQFYV
HUMAN TRAMD2  LGMSIVIHILLGTLGYMKFGSDTQASITLNLPNCWLYQSVKLMYSIGIFFTYALQFHV
HUMAN TRAMD3  LGMVIVTILYIISLGCLGYLQFGANIQGSITLNLPNCWLYQSVKLLYSIGIFFTYALQFYV 370        380        390        400        410        420
HUMAN TRAMD1  PAEIIIPFFAISRVSTRWALPLDLSIRLVMVCLTCLLAILIPRLDLVISLVGSVSGTALAL
HUMAN TRAMD2  PAEIIIPFFAISQVSEISWALFVDLSVRSALVCLTCVSAILIPRLDLVISLVGSVSSSALAL
HUMAN TRAMD3  PAEIIIPFFVSRIAPEHCELVDLFVRTVLVCLTCILAILIPRLDLVISLVGSVSSSALAL 430        440        450        460        470        480
HUMAN TRAMD1  IIPPLLEVTTFYSEGMSPLTIFKDALISILGFVGFVVGTYQALDELLKISEDSHPFSNSTT
HUMAN TRAMD2  IIPALLEIVIFYSEDMSCVTIAKDIMISIVGLLGCIEGTYQALYELPQP-ISHSMANSTG
HUMAN TRAMD3  IIPPLLEVTTFYSEGMSPLTIFKDALISILGFVVGLLGCIEGTYEALYELIQPSNAPIFTINSTC 490        500        510        520        530        540
HUMAN TRAMD1  FVR
HUMAN TRAMD2  VHAXL
HUMAN TRAMD3  AFI
```

```
MOUSE TRAMD3  MSTQRLRNEDYHDYSSTDVSPEESPSEGLGSFS-PGSYQRLGESISSMTWFQTLIHLLKGN   60
HUMAN TRAMD3  MSTQRLRNEDYHDYSSTDVSPEESPSEGLNNLSSPGSYQRFGQSNSTTWFQTLIHLLKGN

MOUSE TRAMD3  IGTGLLGLPLAVKNAGLLLGPLSLLVIGIVAVHCMGILVKCAHHLCRRLNKPFLDYGDTV  120
HUMAN TRAMD3  IGTGLLGLPLAVKNAGIVMGPISLLIIGIVAVHCMGILVKCAHHFCRRLNKSFVDYGDTV

MOUSE TRAMD3  MYGLECSPSTWVRNHSHWGRRIVDFFLIVTQLGFCCVYFVFLADNFKQVIEAAANGTTTNC  180
HUMAN TRAMD3  MYGLESSPCSWLRNHAHWGRRVVDFFLIVTQLGFCCVYFVFLADNFKQVIEAAANGTTNNC

MOUSE TRAMD3  NNNVTVIPTPTMDSRLYMPSFLPFLVLLSFIRNLRVLSIFSLLANISMFVSLIMIYQFIV  240
HUMAN TRAMD3  HNNETVILTPTMDSRLYMLSFLPFLVLLVFIRNLRALSIFSLLANITMLVSLVMIYQFIV

MOUSE TRAMD3  QRIPDPSHLPLVAPWKTYPLFFGTAIFAFEGIGVVLPLENKMKDSQKFPLILYLGMAIIT  300
HUMAN TRAMD3  QRIPDPSHLPLVAPWKTYPLFFGTAIFSFEGIGMVLPLENKMKDPRKFPLILYLGMVIVT

MOUSE TRAMD3  VLYISLGSLGYLQFGANIKGSITLNLPNCWLYQSVKLLYSIGIFFFTYALQFYVVAAEIIIP  360
HUMAN TRAMD3  ILYISLGCLGYLQFGANIQGSITLNLPNCWLYQSVKLLYSIGIFFFTYALQFYVVPAEIIIP

MOUSE TRAMD3  AIVSRVPEHFELMVDLCVRTAMVCVTCVLAILIPRLDLVISLVGSVSSALALIIPPLLE  420
HUMAN TRAMD3  FFVSRAPEHCELVVDLFVRTVLVCLTCILAILIPRLDLVISLVGSVSSSALALIIPPLLE

MOUSE TRAMD3  VVTYYGEGISPLTVTKDALISILGFVGFVVGTYESLCELIQPSHSDSSTNSTSAFI    480
HUMAN TRAMD3  VTFFYSEGMSPLTIFKDALISILGFVGFVVGTYEALYELIQPSNAPIFINSTCAFI
```

FIG. 17

```
ACGGGTGGGGCTGCCGGGCAGCAAAGGACCATGGCGAGGGCTGATACTGAACCCGGGAAGGGTGGGCTGTGCTGAAGCCAGACCCAGCTGGGCAGGACCACTCGCCT      120
TCCTCCGGGCGTGCAGATGCTCCAG CTGCC ATG TCC ACG CAG AGA CTT CGG AAT GAA GAC TAC CAC GAC TAC AGC GAC GTG AGC CCT GAG      217
                           M   S   T   Q   R   L   R   N   E   D   Y   H   D   Y   S   D   V   H   P   E       22
GAG AGC TCG CCG GAA GGC CTC AAC AAC ATT GGC AAT ATT GGC AAT ATC GGC ATC GTG GCC ATC GTA GGC ATG AGG CTG AAT AAA TCC      307
 E   S   S   P   E   G   L   N   N   I   G   N   S   T   T   W   F   Q   T                                         52
```

```
                                                                                          367
H  F  E  L  M  V  D  L  C  V  R  T  A  M  V  C  V  T  C  V  L  A  I  L  I                1306
CAT TTC GAG CTG ATG GTG GAC CTT TGT GTG CGC ACC GCC ATG GTC TGT GTG ACA TGT GCC ATC CTC ATC  392
P  R  L  D  L  V  I  S  L  V  G  S  S  V  S  S  A  L  A  L  I  I  P  P  L               1381
CCA CGC CTG GAC CTG GTC ATC TCC CTG GTG GGC ATT AGC AGC GTC AGC AGC GCC CTG ATC ATC CCG CCC CTG  417
L  E  V  V  T  Y  Y  G  E  G  I  S  P  L  T  V  T  K  D  A  L  I  S  I  L               1456
CTG GAG GTG GTC ACC TAC TAT GGA GAG GGC ATT AGC CCC CTG ACC GTC ACC AAG GAT GCC CTC ATC AGC ATC CTG  442
G  F  V  G  F  V  G  V  G  T  Y  E  S  L  C  E  L  I  Q  P  S  H  S  D  S               1531
GGC TTC GTG GGC TTC GTG GGG ACC TAC GAG TCT CTG TGT GAG CTC ATC CAG CCA AGC CAT AGC GAC TCC TCT   467
T  N  S  T  T  S  A  F  I  *                                                              1622
ACC AAT TCC ACC AGT GCC TTC ATA TAA GGATCTGGGTGCTCCCCTCCACCAGCTCACCCTGTGTCTCCCAGTAGTGTCCAAGCCGAA  475
TTC                                                                                       1625
```

FIG. 20B

```
                                                                                                    5
                                                                                                    6
GAATTCGGCT TGG GGA AGG CGC ATC GTG GAC TTC TTC CTC ATC GTC ACT CAG CTG GGA TTC TGC TGT GTC TAC TTC   (7)
           W   G   R   R   I   V   D   F   F   L   I   V   T   Q   L   G   F   C   C   V   Y   F
GTG TTT CTG GCG GAC AAC TTT AAG CAG ATA GCC AAT GCC ACC AAC TGC AAC AAT GTG                          ?
 V   F   L   A   D   N   F   K   Q   I   A   N   A   T   N   C   N   N   V
ACC GTG ATC CCG ACG CCC ACC ATG GAC TCT CGA CTC TAC ATG AGT TAT CAA AAA GCA GCA GAA
 T   V   I   P   T   P   T   M   D   S   R   L   Y   M   S   Y   Q   K   A   A   E
AAT GAG GCT GGA AGG AGC AGC CTG GTG TTT TTG GGT TTG AAT CAA GCC GAT GTT GAA GCT GGA ATT
 N   E   A   G   R   S   S   L   V   F   L   G   L   N   Q   A   D   V   E   E   A   G   I
TTT TTT TTA TGA ATAATAAAATCCAGTTCTATATCGTAAAGCTGTCAGTATATGTTGAAATCAAGAACGAGAGAACTGCCCTACAGAGAGTCTT
 F   F   L   *
AACAGCCAGACAGTACGCTGTGCTGGCCGCTACCTGGATGCATTGCGTACACGCGTGGGGCATGCAGAGCTTCAGAGTGCATTGCGAACATGCATG
GGTCATGTCATAGCTTCAGAGTCATTGTAGTTGTACATGTGGGTCATGTCAGAGCTTCATTGGGTTCACATATGGATCTTGTTGTTAAATT
TCCACTTCAATAAATGAATTTTATTTTTATTTTTGAAAAAAAAAAA
```

```
MSTQRLRNEDYHDYSSTDVSPEESPSEGLGSFSPGSYQRLGENSSMTWFQTLIHL
LKGNIGTGLLGLPLAVKNAGLLLGPLSLLVIGIVAVHCMGILVKCAHHLCRRLNK
PFLDYGDTVMYGLECSPSTWIRNHSHWGRRIVDFFLVVTQLGFCCVYFVFLADN
FKQVIEAANGTTTNCNNNETVILTPTMDSRLYMLTFLPFLVLLSFIRNLRILSIFSL
LANISMFVSLIMIYQFIVQRIPDPSHLPVAPWKTYPLFFGTAIFAFEGIGVVLPLEN
KMKDSQKFPLILYLGMAIITVLYISLGSLGYLQFGDIKGSITLNPNCWLYQSVK
LLYSIGIFFTYALQFYVAAEIIIPAIVSRVPERFELVVDLSARTAMVCVTCVAVLIP
RLDLVISLVGSVSSSALALIIPPLLEVTTYYGEGISPLTITKDALISILGFVGFVVGTY
ESLWELIQPSHSDSSTNSTSAFI
```

FIG. 21A

```
   1 ggcacgagcc ggaagcggct gtccaggagg ctaaaaacca tggctagggg tcggcgctga
  61 ggctgcgcga ggtgggctga gcgggagcca gagcgggagc ccgagccgga gccggagcca
 121 gagcccgggc cgggccgggc cgaccgctac catgtccaca cagaggcttc ggaacgaaga
 181 ctatcatgac tacagttcca ctgacgtgag ccccgaggag agcccatctg aaggcctcgg
 241 gagcttctcc cccggctcct accagcgctt aggagagaac agtagcatga catggttcca
 301 gaccctgatc cacctgctaa aaggcaacat cggcaccggg ctgctgggc tgcctctagc
 361 agtgaagaat gcaggcctct gtttgggccc tctcagcctg ctggtgattg catcgtggc
 421 tgtgcactgc atgggcatcc tggtgaagtg cgctcatcac ttgtgtcgga gactgaacaa
 481 acccttctct gactatgggg acacggtgat gtatggacta gaatgcagcc ccagcacctg
 541 gattcggaac cactcccact ggggaaggcg catcgtggac ttcttcctcg tcgtcactca
 601 gctgggtttc tgctgcgtct actttgtgtt tctggcagac aactttaaac aggtgataga
 661 ggcagccaac gggaccacca ccaactgcaa caacaatgag accgtgatcc taacgcccac
 721 catggactct cgactctaca tgctcacttt cctgcccttc ctggtgctgc tgtctttcat
 781 caggaacttg cgtatcttgt ccatcttctc cctgctggcc aacatcagca tgttcgtcag
 841 ccttatcatg atataccagt tcattgtcca gaggatccca gaccccagcc acctcccctt
 901 ggtggctcca tggaagacct accctctgtt ctttggcaca gcgattttg ctttcgaagg
 961 cattggagtg gtgctacccc ttgagaacaa aatgaaggac tcacagaaat ttccactgat
1021 cctgtatttg gggatggcta tcatcactgt gctctacatc agcctgggga gcctggggta
1081 cctgcagttt ggagctgata tcaagggcag catcacactc aacctgccca actgctggtt
1141 gtaccagtcg gtgaagctgc tgtactccat aggcatcttc ttcacgtatg cgctccagtt
1201 ttatgtcgca gctgagatca tcatcccagc cattgtgtcc cgagtgcctg aacgtttcga
1261 gctggtggtg gacctcagtg ctcgcactgc catggtctgt gtgacatgtg ttctggccgt
1321 cctcatcccc cgcctggacc tggtcatctc cctggtgggc tctgtgagca gcagcgccct
1381 ggccctcatc atcccacccc tgctggaggt gaccacctac tatggagagg cattagtcc
1441 cctgaccatc accaaggatg ccctcatcag catcctaggc ttcgtgggct tcgtggtggg
1501 gacctatgag tctctgtggg agctaatcca gccaagccat agcgactcct ctaccaattc
1561 caccagtgcc ttcatataag gatctgggtg tgctcccttt acctgcccag ccctaccctg
1621 tgtgtctccc agtagtgtcc cacatcctta ggtgtggctc agcctctgga aaaaggcagg
1681 gttactgcct gggcactcct ctggcattgg acccttgggt aacctgggct acatgagaca
1741 gatgagggga gggcagggag cacccctcca cttgtgatgg tgcagtcactg ctccccttta
1801 tcatgcctcc tccttcctcg tgcc
```

MOUSE Gcm2 AP081556:

```
   1 atgccagcag acagcacgca ggacgaggat gctgtgctct cctacgggat gaaactcacg
  61 tgggacatca atgacccaca gatgcctcag gaaccaaccc actttgacca cttccgggag
 121 tggcctgatg ccacgtgcg cttcatctac agcagccagg agaagaaggc tcagcgccac
 181 ctgagtggct gggccatgcg caacaccaac aaccacaatg ccacatcct caagaagtcc
 241 tgcctgggcg tggtggtgtg tgcacgcgct tgcgccctga aggatggctc gcacctgcag
 301 ctgaggccag ccatctgtga caaggcccgg ctgaagcaac aaaagaaagc ttgccccaac
 361 tgtcactcac ctttggagct ggttccttgc cgacggcaca gcggataccc tgtcaccaac
 421 ttctggagac ttgatggcaa tgcaattttt tttcaggcca aaggagttca tgatcacccc
 481 agaccagaga gtaagtcaga gacagaaggc agaagaagtg ccctcaagag acagatggct
 541 tctttctacc aaccccagaa aaggagatca ggggagcctg aggcaagaag cactcaggac
 601 atcaggggac acctcaatag cacggctgcc ctggaaccca cagaactatt tgatatgact
 661 gctgatacca gcttccctat tccagggcag ccctccccctt cgttcccaaa ctctgatgtc
 721 tacagagtta cctgtgacct gcccacctttt caaggagata taatactgcc ctttcagaaa
 781 tatccaaatc caagcattta tttccccggg ccaccttggg gctatgagtt ggcaagttct
 841 ggggttacag gttcgagtcc atattccacc ctgtataaag attcctccga ggtccccgat
 901 gacccagatt ggattcctct aaactcacta cagtataatg tcagttccta tggcagctat
 961 gagagaacct tggatttcac agctaggtat catagctgga accaacaca cgggaagccc
1021 agccttgagg agaaggttga ctgtgagcaa tgccaggctg tgcccacatt gccttattac
1081 aacctagagc tgccctgcag gtacctgcca gtgccagcag cgggtagcca ggctctgcag
1141 acagtaatca ccaccacagt ggcttaccag gcctaccagc accctgctct gaaacacggt
1201 gacagcatgc aggaggttag cagccttgcc agctgcacct atgcctcgga aaacctccca
1261 atgcccatct atccaccagc cttagaccct caagagggag tcattcaggc agtctctcct
1321 tcagggagag cccctctgaa agtccctgga gactgccagg cccccagacc cactctggat
1381 tttcctcaag aagcagatcc ctccgggaca gatggagcag atgtgtggga tgtgtgtctg
1441 tctggggtgg gctctgtgat gggttactta gataggacag ggcagccctt tagctttgac
1501 aatgaggact tttaagagaa atccagggat ccgatcaagc c
```

FIG. 24A

MOUSE PARATHYROID HORMONE cDNA NM_020623:

```
   1 ctgcatatga aactcagact tgaagaactg cagtccagtt catcagctgt ctggtttact
  61 ccagcttact acagcatcag tttgtgcatc cccgaaggat ccccctttgag agtcattgta
 121 tgtaaagatg atgtctgcaa acaccgtggc taaagtgatg atcatcatgc tggcagtctg
 181 tcttcttacc caaacggatg ggaaacccgt gaggaagaga ctgtcagtg aaatacagct
 241 tatgcacaac ctgggcaaac acctggcctc catggagagg atgcaatggc tgagaaggaa
 301 gctgcaagat atgcacaatt ttgttagtct tggagtccaa atggctgcca gagatggcag
 361 tcaccagaag cccaccaaga aggaggaaaa tgtccttgtt gatggcaatc caaaaagtct
 421 tggtgaggga gacaaagctg atgtggatgt attagttaaa tcaaaatctc agtaaatgct
 481 gatttattct agacagtgca gggcactgac atatgctgct acctttcaa gcttatgaag
 541 atcaccaagt gctaatactt ctactgtaat gaaactttgg aatttttttg attacatttt
 601 tgctcattta aggtctcttt caatgattcc atttcaatat gctcttcttt ttaaagtact
 661 actcatttcc acttctctcc ttaaatataa ataaagcttt aatgctcatg aatc
```

FIG. 24B

MOUSE PARATHYROID HORMONE PRECURSOR, EXONS 2, 3 AND cDNA AF066075:

```
   1 gctaatcatt gcttgctctg gtggctatgg ataacaacta ctgaggctgt acttacaata
  61 ctttagaaca ctgacagtat cttaaaatat ctcaaggttg ttccttcttt cagtaaagat 121 gatgtctgca aacaccgtgg ctaaagtgat gatcatcatg ctggcagtct gtcttcccac
 181 ccaaacggat gggaaacccg tgaggtaagt gctgcagccc attgtgcaca gggaagtgtg
 241 gactcgaggc tttgtagtgg gttttaacgt tgtgggcatg gggagctaat ggaacggtcc
 301 gctctttctc ttctttctag gaagagagct gtcagtgaaa tacagcttat gcacaacctg
 361 ggcaaacacc tggcctccat ggagaggatg caatggctga aaggaagct gcaagatatg
 421 cacaatttcg ttagtcttgg agtccaaacg gctgccagag atggcagtca ccagaagccc
 481 accaagaagg aggaaaatgt ccttgttgat ggcaatccaa aaagtcttgg tgagggagac
 541 aaagctgatg tggatgtatt agttaaatca aaatctcagt aaatgctgat ttattctaga
 601 cagtgcaggg cactgacata tgctgctacc ttttcaagct tatgaagatc accaagtgct
 661 aatacttcta ctgtaatgaa actttggaat ttttttgact acattttgc tcatttaagg
 721 tctctttcaa tgattccatt tcaatatgct cttcttttta agtactact catttccact
 781 tctctcctta aatataaata aagctttaat gctcatgaat caagtaagca gtgtttcttg
 841 ttaaaacttt gtctcagttg gagggttggc tcagaagtta aaattgcaaa ctgtagggct
 901 ggagagatgg ttcagcggtt aagagcactg accgctcttc cagaggtcct gagtttaatt
 961 cccagcaacc acatggtggc tcacaatcat ctgtaatggg atctgatgcc ctcttctggt
1021 gtgtctgaag acagcaacag tgtac
```

FIG. 24C

```
TAATACGACT CACTATAGGG CGAATTGGAG CTCCACCGCG GTGGCGGCCG CTCTAGAACT AGTGGATCCC
CCGGCTGCA GGAATTCGGC TTCCACTCAA GGCAGGAAAT TAGCAGATAA ATGACAAAAA CAAGATGGCG
GTTTCCACAG GTGAGGTCTC CACAGTGTGG AAAACTAGAG AACGACCAAC ATTTCTTTTG TTTTTAATGA
CCATCTATCT ACACCTTGTA TGCGGTGTAG TGCCCCCCA TCTCCTTTGC GCGGCGGCGC ACACACACAC
GGTACTGGGG ATATGCTACA CCTGTTTTT GTTTTGTTTT GTTTTTTCCT GTCTTGGACC AGAGAAAAGG
CAAAGTGAAA AAATTCATAG ACAAACATAAG GAATTCGATA TCAAGCTT CTCTGTCACT GAATAAACAT
GGTGGAGTTG GACAGAAGCC
```

FIG. 29

MOUSE TRAMD2 IN SITU HYBRIDIZATION PROBE

TAATACGACT CACTATAGGG CGAATTGGGC CCTCTAGATG CATGCTCCGAG CGGCCGCCAG TGTGATGGAT
ATCTGCAGAA TTCGGCTTGA GGTACTGCTG CTGCTTCTGC TGTTGCTGCT GCCTTTTGAG GAGGCTGTAG
ACCGACCGAA CATATTCCGC CAACTTCTCT AAGCAGCGGC ACATTCCCCA TGATGGACAG
GCAGCAGGGG TATAGCACTC AGCTGCCGCA GGCTCTCAGT GGGCTTTCAT CAGGAGAAGC CATACAGCAG
GTCTCAGGTT CTGGCTCCTG ACTCCTGGGT ATGCCTGGCC ACAGACTTTC AGCCCTCTCCC AGATCAGTCC
TTGATGCTGT GGTCCACGGG GAACACTGAC CAAGGAGGAG GAAGTATCA TTAGACCGGA AGTTCTGGTG
CCTAGCTGTG GGCTTTAAGC CACACTGGCG GCCGTTACTA GTGGATCC

FIG. 30

MOUSE TRAMD3 IN SITU HYBRIDIZATION PROBE

TAATACGACT CACTATAGGG CGAATTGGGC CCTCTAGATG CATGCTCGAG CGGCCGCCAG TGTGATGGAT
ATCTGCAGAA TTCGCTTAT GGAAGTCCAC AGAAGCATGG GGCTTCCAGA GGCGGTGCAT GCTCACATGA
TCTGCTTGAG GTCTCTGAGC CAGCTGGGAG TGCCAGCTCA GGCTTCCAGA CTCCATACTT GAGGCAACGG
TAGGAGAACT GAGAGCCCAT CGTCATCCTT GACTACACAG CAAGCAAGTT CAAAGCCAAC TCTGGTGACA
TGAGACCCTG TCTGAGGATG TGGGACACT ACTGGGAGAC ACACAGGGTG AGGCTGGTGG AGGAGCACA
CCCAGATCCT TATATGAAGG CACTGGTGCA ATTGGTAGAG GAGTCGCTAT GGCTTGGCTG GAAAGCCGAA
TTCCAGCACA CTGGCGGCCG TTACTAGTGG ATCC

FIG. 31

USE OF TRAMDORINS IN DIAGNOSTIC AND THERAPEUTIC METHODS

This is a Conversion of copending provisional application(s) 60/313,907 filed on Aug. 21, 2001.

This invention was made with government support under grant R01-NS40751, from the National Institute of Neurological Disorders and Stroke. The government has certain rights in the invention.

FIELD OF THE INVENTION

The present invention relates to a gene family, the tramdorins. The genes may be used in a variety of applications, including diagnostics and therapeutics.

BACKGROUND

Identification of genes involved in nervous system function may provide markers for various steps in nervous system development and/or repair following disease or injury. Some of these steps may also be important in diseases affecting the nervous system, including but not limited to Charcot-Marie-Tooth syndrome, multiple sclerosis (MS) and Guillain-Barre syndrome, which are characterized by demyelination of axons in the peripheral or central nervous system. The frequencies of these diseases range from 1/1000 (U.S.) for multiple sclerosis to 1.5/100,000 for Guillain-Barre syndrome. These diseases are devastating for those affected by them, often resulting in the loss of the use of limbs. For example, Guillain-Barre syndrome generally requires hospitalization to provide respiratory and cardiac support during an episode. In terms of economic costs, MS carries a substantial economic burden. A cost of illness (COI) study conducted by Bourdette et al. retrospectively examined costs to the US Veterans affairs for the treatment of 165 patients with MS over a 3-year period (Bourdette D. N. et al., *Arch Phys Med Rehabil* 74:26-31 (1993)). Drug costs were not included in the study. The average cost to the VA associated with these patients was estimated at $35,000 per year.

Gene products of genes involved in nervous system function may also localize in tissues not associated with the nervous system and also may provide markers for various steps in the development of tissues not associated with the nervous system and/or repair of the same proximal to disease or injury.

What is needed are markers for various tissue processes (including but not limited to the nervous system) which can be used in the development of diagnostic and therapeutic agents for a variety of disorders including, but not limited to, pathologies of the nervous system.

SUMMARY OF THE INVENTION

In several embodiments, isolated nucleic acid sequences encoding tramdorins are contemplated. In one embodiment, an isolated nucleic acid sequence selected from the group consisting of the cDNA sequence encoding mouse tramd 2 (SEQ ID NO:1), the cDNA sequence encoding mouse tramd 3 (SEQ ID NO:2), the cDNA sequence encoding human tramd 1 (SEQ ID NO:3), the cDNA sequence encoding human tramd 2 (SEQ ID NO:4), the cDNA sequence encoding human tramd 3 (SEQ ID NO:5), the cDNA sequence encoding rat tramd 1 (SEQ ID NO:6), the genomic sequence of mouse tramd 1 (SEQ ID NO:7) and the genomic sequence of mouse tramd 3 (SEQ ID NO:8) is contemplated.

In another embodiment, portions of nucleic acid sequences are contemplated, including, but not limited to, a portion of the cDNA sequence encoding mouse tramd2 (SEQ ID NO:1), a portion of the cDNA sequence encoding mouse tramd3 (SEQ ID NO:2), a portion of the cDNA sequence encoding human tramd1 (SEQ ID NO:3), a portion of the cDNA sequence encoding human tramd2 (SEQ ID NO:4), a portion of the cDNA sequence encoding human tramd3 (SEQ ID NO:5), a portion of the cDNA sequence encoding rat tramd1 (SEQ ID NO:6), a portion of genomic sequence encoding mouse tramd1 (SEQ ID NO:7) and a portion of the genomic sequence encoding mouse tramd3 (SEQ ID NO:8). Polymorphisms within any of these sequences are also contemplated. Polymorphisms within the genomic sequences of human tramd1 (SEQ ID NO:9), human tramd2 (SEQ ID NO:10), human tramd 3 (SEQ ID NO:11) and human tramdL (SEQ ID NO:12) are also contemplated.

In some embodiments, said nucleic acid sequences or portions of nucleic acid sequences may be fused to other nucleic acid sequences, such that gene fusions are provided.

In some embodiments, RNA transcribed from any of the sequences is contemplated. The RNA transcripts may be synthesized in vivo, or in vitro, by means known in the art. In some embodiments, RNA transcribed from the group consisting of mouse tramdorin 1 cDNA (SEQ ID NO:13), mouse tramdorin 2 cDNA (SEQ ID NO:1), mouse tramdorin 3 cDNA (SEQ ID NO:2), human tramdorin 1 cDNA (SEQ ID NO:3), human tramdorin 2 cDNA (SEQ ID NO:4) and human tramdorin 3 cDNA (SEQ ID NO:5) is contemplated.

In some embodiments, a vector comprising said isolated nucleic acid sequences (for example, human tramd 1 cDNA (SEQ ID NO:3), human tramd2 cDNA (SEQ ID NO:4), human tramd3 cDNA (SEQ ID NO:5), mouse tramd 1 cDNA (SEQ ID NO:13), mouse tramd 2 cDNA (SEQ ID NO:1), mouse tramd 3 cDNA (SEQ ID NO:2), or portions thereof is contemplated. In some embodiments, the vector is an expression vector. In some embodiments, the expression vector is suitable for expression of the nucleic acid sequences of interest in a eukaryotic host, while in other embodiments, the expression vector is suitable for expression in a prokaryotic host. Representative eukaryotic hosts and host cells for the expression vectors include, but are not limited to mouse, yeast, *Xenopus* and cultured mammalian cells.

In some embodiments, a host cell transfected by a vector comprising the nucleic acid sequences of interest is contemplated. In some embodiments, the host cell is a eukaryotic cell. In some embodiments, the host cell is a *Xenopus* oocyte. In other embodiments, the host cell is a yeast cell. In yet other embodiments, the host cell is a mouse embryonic stem cell. Other host cells are contemplated, including but not limited to cultured mammalian cells (for example, COS-7 cells).

In some embodiments, a *Xenopus* oocyte is injected with nucleic acid comprising an RNA transcribed from a nucleic acid sequence of interest. In some embodiments, the RNA is a synthetic RNA and comprises additional flanking sequences and a cap.

In some embodiments, a method of identifying proteins which interact with tramdorins is contemplated. In one embodiment, the method comprises the yeast two-hybrid method. In one embodiment, the method comprises (a) providing: (i) a first recombinant vector comprising a portion of a tramdorin in operable combination with the DNA binding domain of a transcriptional activator, such that a chimeric protein will be expressed, (ii) a population of second recombinant vectors, wherein said population comprises a library of cDNA sequences in operable combination with the activation domain of a transcriptional activator, such that a population of chimeric proteins will be expressed, and (iii) a yeast host comprising a reporter gene in operable combination with the DNA binding sites' for said transcriptional activator; (b) introducing said first vector and said population of second vectors into said yeast host to generate a population of transformed yeast; (c) subjecting said population of transformed to yeast to conditions such that said chimeric proteins are expressed; (d) screening said population for members which express said reporter gene, and; (e) isolating the cDNA fragment from said second vector from members of the population which express the reporter gene. In some embodiments, the portion of a tramdorin is a portion of mouse tramdorin 1 (SEQ ID NO:14). In some embodiments, the portion of mouse tramdorin 1 may be the N-terminal 51 amino acids (SEQ ID NO:15) or the first intracellular loop of tramdorin 1 (SEQ ID NO:16). In other embodiments, the portion of the tramdorin is a portion of a tramdorin selected from the group consisting of mouse tramdorin 2 (SEQ ID NO:17), mouse tramdorin 3 (SEQ ID NO:18), human tramdorin 1 (SEQ ID NO:19), human tramdorin 2 (SEQ ID NO:20), human tramdorin 3 (SEQ ID NO:21) and rat tramdorin 1 (SEQ ID NO:22).

In other embodiments, a variation on the yeast two hybrid method is contemplated to detect proteins which interact with tramdorins. The method comprises providing (i) a first recombinant vector comprising a portion of a tramdorin in operable combination with Sos, such that a chimeric protein will be expressed, (ii) a population of second recombinant vectors, wherein said population comprises a library of cDNA sequences in operable combination with myristylation signal, such that a population of chimeric proteins will be expressed, and (iii) a yeast host comprising a temperature sensitive mutation in the cdc25 gene; (b) introducing said first vector and said population of second vectors into said yeast host to generate a population of transformed yeast; (c) subjecting said population of transformed to yeast to conditions such that said chimeric proteins are expressed and said myristylation fusions will be targeted to the membrane; (d) screening said population for members which are viable at elevated temperatures, and; (e) isolating the cDNA fragment from said second vector from members of the population which are viable at elevated temperatures. In some embodiments, said tramdorin is a portion of mouse tramdorin 1 (SEQ ID NO:14). In other embodiments, said portion of tramdorin is selected from the group consisting of mouse tramdorin 2 (SEQ ID NO:17), mouse tramdorin 3 (SEQ ID NO:18), human tramdorin 1 (SEQ ID NO:19), human tramdorin 2 (SEQ ID NO:20), human tramdorin 3 (SEQ ID NO:21) and rat tramdorin 1 (SEQ ID NO:22).

In yet other embodiments, another variation on the yeast two-hybrid system is contemplated to identify proteins which interact with tramdorins. In some embodiments, the method comprises (a) providing (i) a first recombinant vector comprising a full length tramdorin, (ii) a population of second recombinant vectors comprising a library of cDNA sequences fused to a ras gene lacking a myristylation signal, (iii) a yeast host comprising a temperature sensitive cdc25 mutation; (b) introducing said first recombinant vector and said population of second recombinant vectors into said yeast host to generate a population of transformed yeast; (c) subjecting said population of transformed yeast to conditions such that said tramdorin protein is expressed and localizes to the membrane and said ras fusions are expressed; (d) screening said population for members which are viable at elevated temperatures, and; (e) isolating the cDNA fragment from said second vector from members of the population which are viable at elevated temperatures. In some embodiments, said expressed tramdorin protein is mouse tramdorin 1 (SEQ ID NO:14). In other embodiments, said tramdorin is selected from the group consisting of mouse tramdorin 2 (SEQ ID NO:17), mouse tramdorin 3 (SEQ ID NO:18), human tramdorin1 (SEQ ID NO:19), human tramdorin 2 (SEQ ID NO:20), human tramdorin 3 (SEQ ID NO:21) and rat tramdorin 1 (SEQ ID NO:22).

In some embodiments, methods to detect tramdorin ligands are contemplated. In one embodiment, the method comprises (a) providing (i) a recombinant expression vector comprising a tramdorin nucleic acid sequence, (ii) a host cell and (iii) labeled candidate ligand molecules; (b) introducing said recombinant expression vector into said host cell under conditions such that said tramdorin nucleic acid sequence is expressed; (c) contacting said tramdorin-expressing host cells with said labeled candidate ligand molecules, and; (d) measuring the relative uptake of said labeled candidate ligand molecules into said tramdorin-expressing host cells. In some embodiments, said host cells are COS-7 cells. In other embodiments, said host cells are *Xenopus* oocytes. In some embodiments, the tramdorin nucleic acid sequence is selected from the group consisting of mouse tramdorin 1 cDNA (SEQ ID NO:13), mouse tramdorin 2 cDNA (SEQ ID NO:1), mouse tramdorin 3 cDNA (SEQ ID NO:2), human tramdorin 1 cDNA (SEQ ID NO:3), human tramdorin 2 cDNA (SEQ ID NO:4), human tramdorin 3 cDNA (SEQ ID NO:5) and rat tramdorin 1 cDNA (SEQ ID NO:6). In some embodiments, said labeled candidate ligand molecules are labeled with tritium (3H). In some embodiments, said labeled candidate ligand molecules include, but are not limited to, small neutral amino acids and γ-aminobutyric acid.

In some embodiments, methods to detect myelination are contemplated. In such embodiments, the expression levels of tramdorin 1 are measured in tissue or cells following injury or a disease process. In some embodiments, the tissue is damaged nervous tissue. In other embodiments, the cells are Schwann cells co-cultured with neurons. In some embodiments, tramdorin expression levels are measured by detection of the levels of tramdorin 1 mRNA. Tramdorin 1 mRNA levels are detected by Northern blot hybridization in some embodiments, while in other embodiments, amplification of reverse transcribed mRNA (i.e. amplification of cDNA) is contemplated.

In some embodiments, methods to detect tramdL fusions in parathyroid tumors, including but not limited to parathyroid adenomas are contemplated. In some embodiments, the tramdL fusion is a fusion (SEQ ID NO:23) between human tramdL sequences and human STK4/Mst-1/Krs-2 sequences (located on human chromosome 5 and human chromosome 20 respectively). In some embodiments, the fusion is detected by amplification of fusion cDNA sequences. The method comprises (a) providing (i) human parathyroid tumor tissue and (ii) tramdL and STK4/Mst-1/Krs-2 primers; (b) isolating RNA from said parathyroid tumor tissue; (c) reverse-transcribing said RNA to generate cDNA sequences; (d) using said primers to amplify said cDNA, and; (e) detecting an amplification product. In other embodiments, the fusion is detected by fluorescence in situ hybridization (FISH). The method comprises; (a) providing: (i) isolated tissue derived from human parathyroid tumors and (ii) differentially labeled tramdL and STK4/Mst-1/Krs-2 probes; (b) hybridizing said probes to said tissue, and; (c) detecting the hybridization pattern of said differentially labeled probes. In some embodiments, the method provides cells cultured from parathyroid tumors in step (a). In some embodiments the tramdL probe comprises labeled sequences from a tramdL-containing bacterial artificial chromosome (BAC). In some embodiments, the label comprises biotin, while in other embodiments the label comprises a fluorescent moiety, including but not limited to fluorescein. In some embodiments, the STK4/Mst-1/Krs-2 probe comprises labeled sequences from a STK4/Mst-1/Krs-2 containing BAC. In some embodiments, the label comprises digoxigenin, while in other embodiments the label comprises a fluorescent moiety, including but not limited to rhodamine.

In some embodiments, a transgenic animal model of parathyroid tumors, including parathyroid adenomas, is contemplated. In some embodiments, the transgenic animal is a transgenic mouse. The transgenic mouse comprises a recombinant construct wherein the STK4/Mst-1/Krs-2-tramdL fusion is expressed under the control of a sequence expressed primarily, if not exclusively, in the parathyroid. Thus, the transgenic animal comprises recombinant nucleic acid constructs comprising the STK4/Mst-1/Krs-2-tramdL fusion (SEQ ID NO:38) operably linked to a regulatory sequence which enable parathyroid-specific expression of the fusion. In some embodiments, the regulatory sequence is the Gcm2 promoter (the Gcm2 cDNA sequence has the accession number AF081556 (SEQ ID NO:24)), while in other embodiments, the regulatory sequence is the regulatory region of the mouse parathyroid hormone gene (mouse parathyroid hormone cDNA has the accession number NM_020623 (SEQ ID NO:25) and mouse parathyroid hormone precursor, exons 2 and 3 cDNA has the accession number AF066075 (SEQ ID NO:33). In some embodiments, the Gcm2 coding region is replaced with the STK4/Mst-1/Krs-2-tramdL fusion (SEQ ID NO:38). In other embodiments, the parathyroid hormone coding region is replaced with the STK4/Mst-1/Krs-2-tramdL fusion (SEQ ID NO:38). In some embodiments, the transgenic animals are contemplated for the testing of therapeutics. Methods of generating transgenic animal models for parathyroid adenomas are also contemplated.

In some embodiments, human tramdorin sequences are contemplated for use in detection of disease-associated mutations in an autosomal recessive Charcot-Marie-Tooth Syndrome demyelinating neuropathy which maps to 5q31-33. Human tramdorin exons can be isolated and sequenced in subjects with the disease and in subjects without the disease to identify mutations in the affected subjects, which are not present in the unaffected subjects.

In some embodiments, tramdorin is contemplated for use in assays of Schwann cell myelination. In some embodiments, tramdorin is overexpressed in isolated Schwann cells, which are co cultured with neurons. The rate of myelination is measured. In some embodiments, tramdorin is overexpressed from a recombinant expression vector comprising tramdorin cDNA. In some embodiments, said cDNA is selected from the group consisting of SEQ ID NO:13 and SEQ ID NO:3. In some embodiments, the overexpressed tramdorin protein is mouse tramdorin 1 (SEQ ID NO:14), while in other embodiments, the overexpressed tramdorin is human tramdorin 1 (SEQ ID NO:19). In some embodiments, myelination is detected by Sudan black staining, while in other embodiments, myelination is detected by measuring Protein 0 (P0) expression.

In some embodiments, mice deficient in tramdorin 1 expression are contemplated. In some embodiments, tramdorin 1 sequences are deleted in the tramdorin 1-deficient mice, while in other embodiments, a portion of the tramdorin sequence is replaced by a marker gene, the expression of which is detectable. In some embodiments, said marker gene is the LacZ gene, the product of which, β-galactosidase, is detectable. In some embodiments, the deletion of tramdorin 1 sequences is mediated by a conditional knockout of tramdorin 1 sequences, although a variety of means to accomplish tramdorin 1 deletion are also contemplated.

In some embodiments, portions of tramdorin nucleic acid sequences are contemplated for use in assays to detect tramdorin expression. In some embodiments, said nucleic acid sequences comprise portions of nucleic acid sequences selected from the group consisting of mouse tramdorin 1 cDNA (SEQ ID NO:13), mouse tramdorin 2 cDNA (SEQ ID NO:1), mouse tramdorin 3 cDNA (SEQ ID NO:2), human tramdorin 1 cDNA (SEQ ID NO:3), human tramdorin 2 cDNA (SEQ ID NO:4), human tramdorin 3 cDNA (SEQ ID NO:5) and rat tramdorin 1 cDNA (SEQ ID NO:6). In yet other embodiments, said portions comprise 300 to 600 base pair fragments that contain the extreme C-terminal and 3' untranslated sequences. In some embodiments, tramdorin expression is detected in tissues. In some embodiments, the detection uses in situ hybridization to sections of fixed tissue. In some embodiments, the tissue comprises human tissue, while in other embodiments the tissue comprises mouse tissue, and in still other embodiments, the tissue comprises rat tissues. Any tissue is contemplated, including but not limited to brain tissue, peripheral nervous tissue and spinal cord tissue. Any method of tissue fixation is also contemplated, including formalin fixation.

In some embodiments, human tramdorin sequences are contemplated for use in the treatment of neuropathic pain.

In some embodiments, human tramdorin sequences are contemplated for use as a marker for bone growth, remodelling and/or osteoclast differentiation. In other embodiments, human tramdorin sequences are contemplated to regulate bone growth.

In some embodiments, human tramdorin sequences are contemplated for use as a marker for adipose tissue. In other embodiments, human tramdorin sequences are contemplated to regulate the proliferation and/or differentiation of adipocytes. In other embodiments human tramdorin sequences are contemplated to regulate the sequestration of glycine into adipocytes.

BRIEF DESCRIPTION OF THE FIGURES

The file of this patent contains at least one drawing executed in color. Copies of this patent with color drawings will be provided by the Patent and Trademark Office upon request and payment of the necessary fee.

FIG. 1A shows Southern blots of PCR-amplified cDNA from Oct-6 wild-type (+/+) and mutant (−/−) sciatic nerve. FIG. 1B diagrammatically shows cDNA fragments that correspond to RDA clone JBSN 125-10, which contains only differentially expressed sequences that are contained in JBSN125. Also shown in FIG. 1B are cDNAs (SEQ ID NO:75) and a Kozak sequence (SEQ ID NO:76) related to mouse EST 1363993.

Figure 2A:
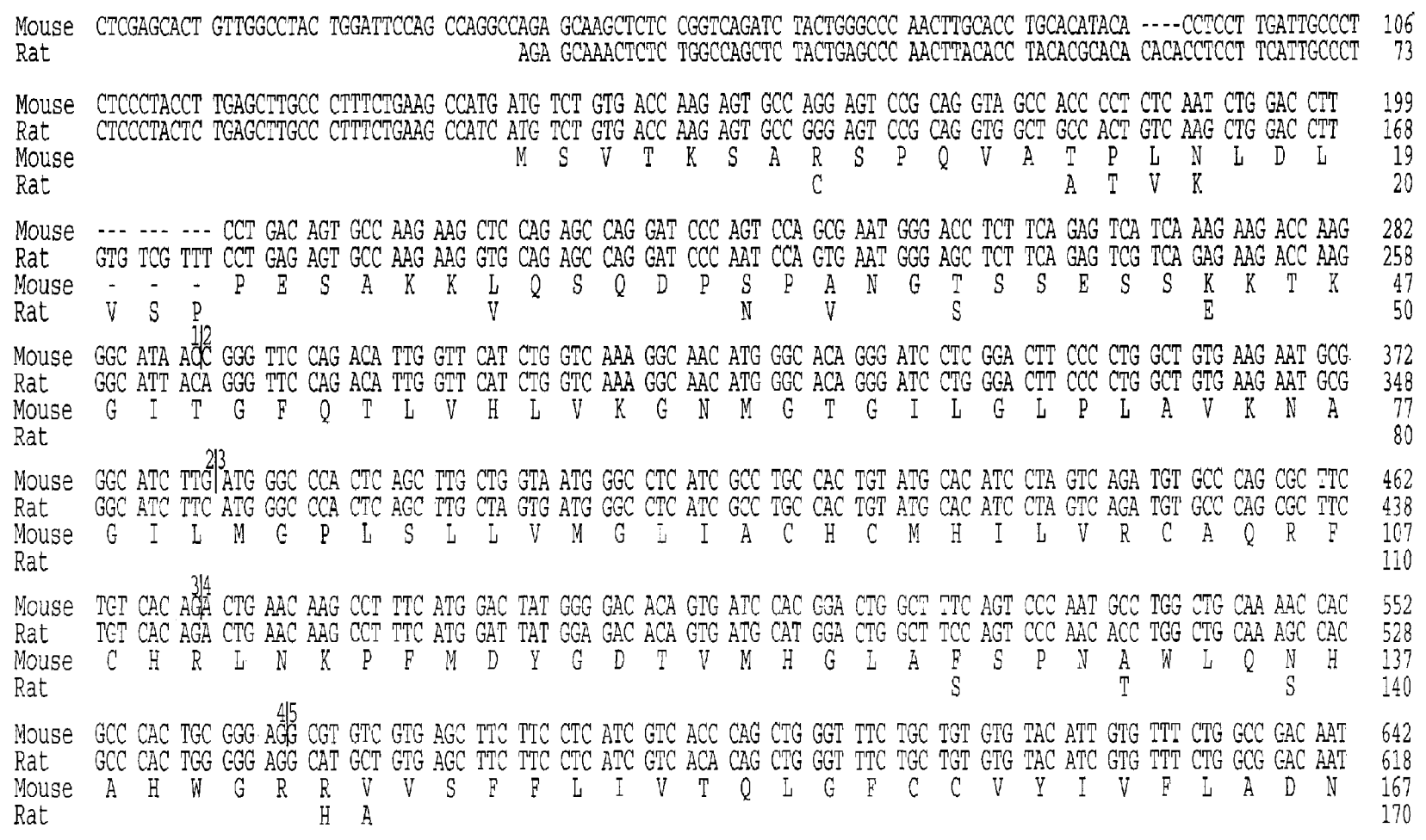
Figure 2B:
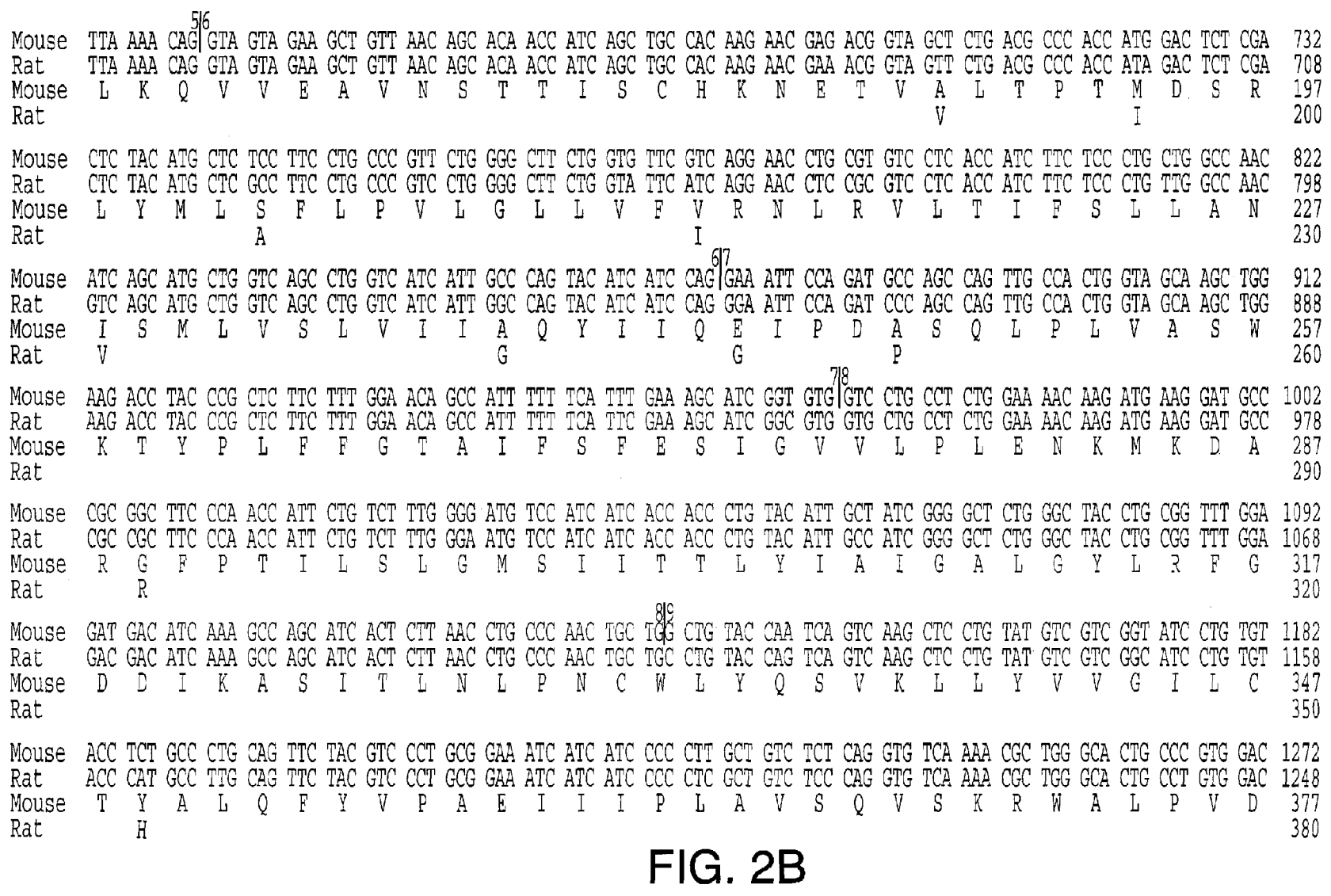
Figure 2C:
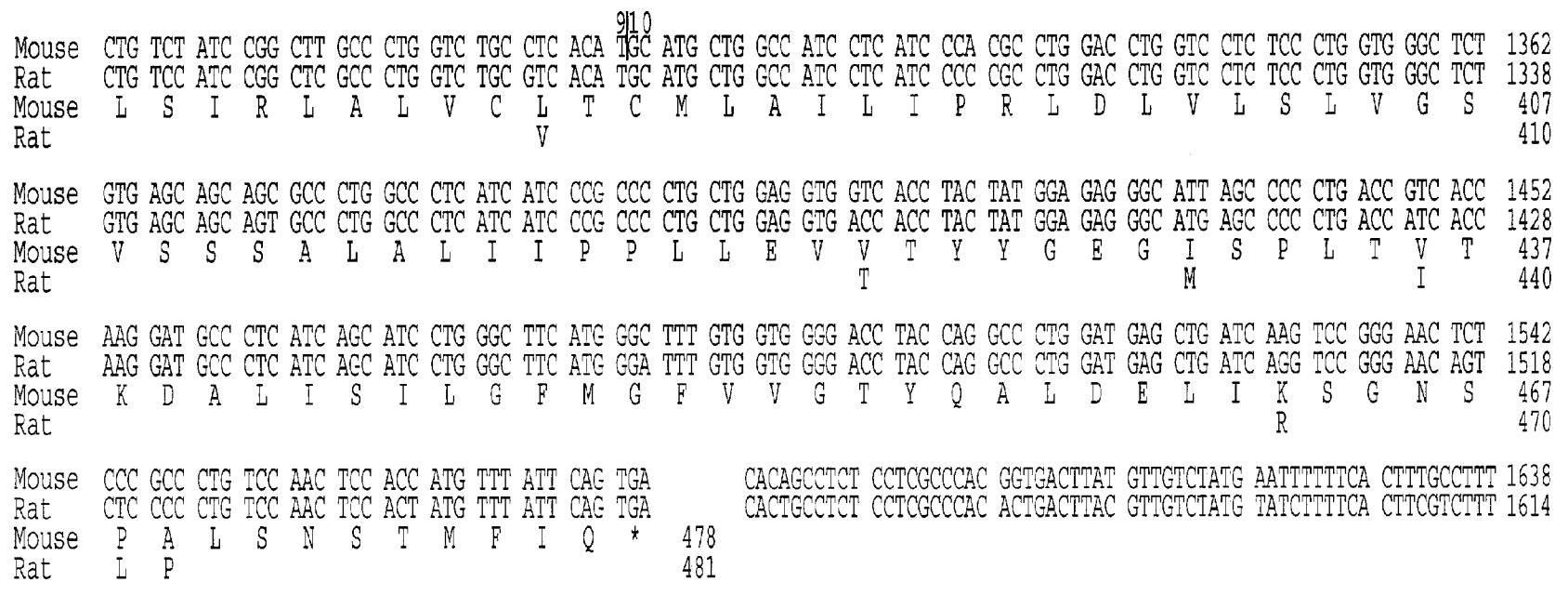

FIGS. 2A-D show the sequences of mouse tramdorin 1 EST cDNA 1920302 (SEQ ID NO:2), a putative rat tramdorin 1 cDNA (SEQ ID NO:6), and the corresponding amino acid sequences (SEQ ID NO:14 and SEQ ID NO:22). Image Consortium numbers are used for EST cDNAs.

FIG. 3A and FIG. 3B shows the structure predicted for the protein encoded by mouse tramdorin 1 EST cDNA 1920302. FIG. 3A shows the putative amino acid sequence (SEQ ID NO:14) encoded by the putative full length EST cDNA 1920302, with structure predictions. FIG. 3B shows a diagram depicting the predicted topology of tramdorin 1.

FIG. 5A shows tramdorin 1 expression following transection injury. FIG. 5B shows Oct-6 expression following transection injury. FIG. 5C shows P0 expression following transection injury. FIG. 5D shows NGFR expression following transection injury. FIG. 5E shows GADPH expression following transection injury. FIG. 5F shows tramdorin expression following crush injury. FIG. 5G shows Oct-6 expression following crush injury. FIG. 5H shows P0 expression following crush injury. FIG. 5I shows NGFR expression following crush injury. FIG. 5J shows GADPH expression following crush injury.

FIG. 6A summarizes the mapping data. FIG. 6B shows a partial mouse chromosome 11 linkage map.

FIG. 8A depicts the human tramdorin 1 locus. FIG. 8B depicts the human tramdorin 2 locus. FIG. 8C depicts the human tramdorin 3 locus. FIG. 8D depicts EST cDNA 1388139, which contains sequences that correspond to both chromosome 5q and to the STK4/Mst-1/Krs-2 locus on chromosome 20.

FIG. 9A and FIG. 9B depict the putative cDNA sequence for human tramdorin 1 (SEQ ID NO:3) and the corresponding amino acid sequence (SEQ ID NO:19).

FIG. 10A and FIG. 10B depict the putative cDNA sequence for human tramdorin 2 (SEQ ID NO:4) and the corresponding amino acid sequence (SEQ ID NO:20).

FIGS. 11A-E depict human STK4/Mst-1/Krs-2 and tramdL sequences. FIG. 11A and FIG. 11B depict genomic sequence from nucleotides 8189548 to 8196472 of human chromosome 20 contig NT011382 (SEQ ID NO:27 (nucleotide sequence) and SEQ ID NO:28 (corresponding amino acid sequence)). FIG. 11C depicts human chromosome 5 genomic sequence between nts 55336 and 56128 (SEQ ID NO:29) on Celera scaffold sequence Gax2HTBL3TT27: 2500000-3000000 and an open reading frame (SEQ ID NO:30). FIG. 11D depicts the fusion junction between the 5' splice site of STK4/Mst-1/Krs-2 exon 9 and a 3' splice site of tramdorin L (SEQ ID NO:31 (nucleotide sequence) and SEQ ID NO:32 (amino acid sequence)). FIG. 11E depicts diagrams of the proteins encoded by STK4/Mst-1/Krs-2 and EST cDNA 1833139.

FIG. 12A shows tramdorin 1 expression. FIG. 12B shows tramd 2 expression. FIG. 12C shows tramd3 expression. FIG. 12D shows GADPH expression.

FIGS. 13A-B depicts the conservation between the putative translation products of human tramdorin 1 (SEQ ID NO:19), human tramdorin 2 (SEQ ID NO:20), and human tramdorin 3 (SEQ ID NO:21).

FIGS. 14A-B depicts the conservation between putative tramdorin 1 proteins from human (SEQ ID NO:19), rat (SEQ ID NO:22), mouse (SEQ ID NO:14), *Drosophila melanogaster* (SEQ ID NO:34) and *C. elegans* (SEQ ID NO:35).

Figure 15A:
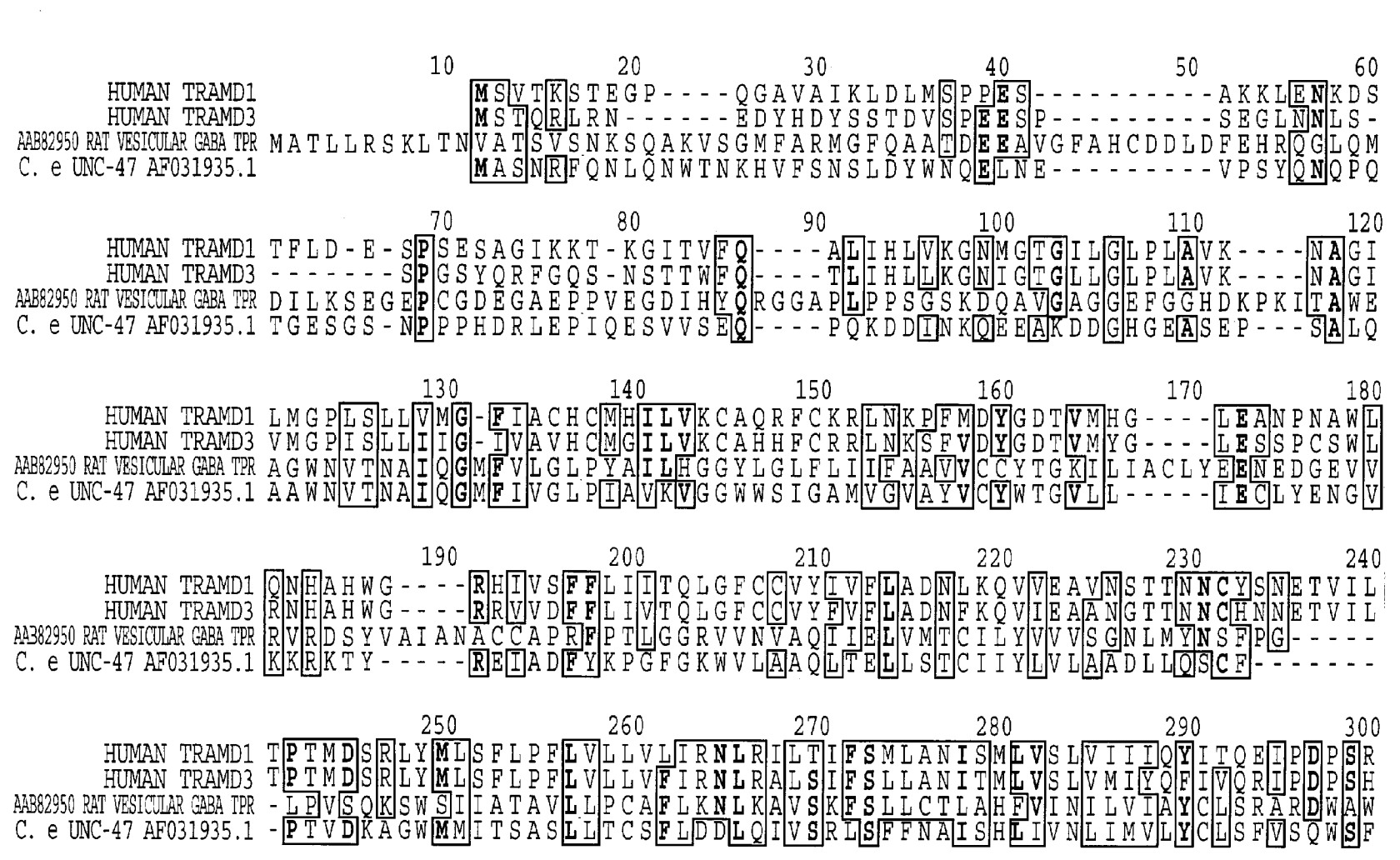
Figure 15B:
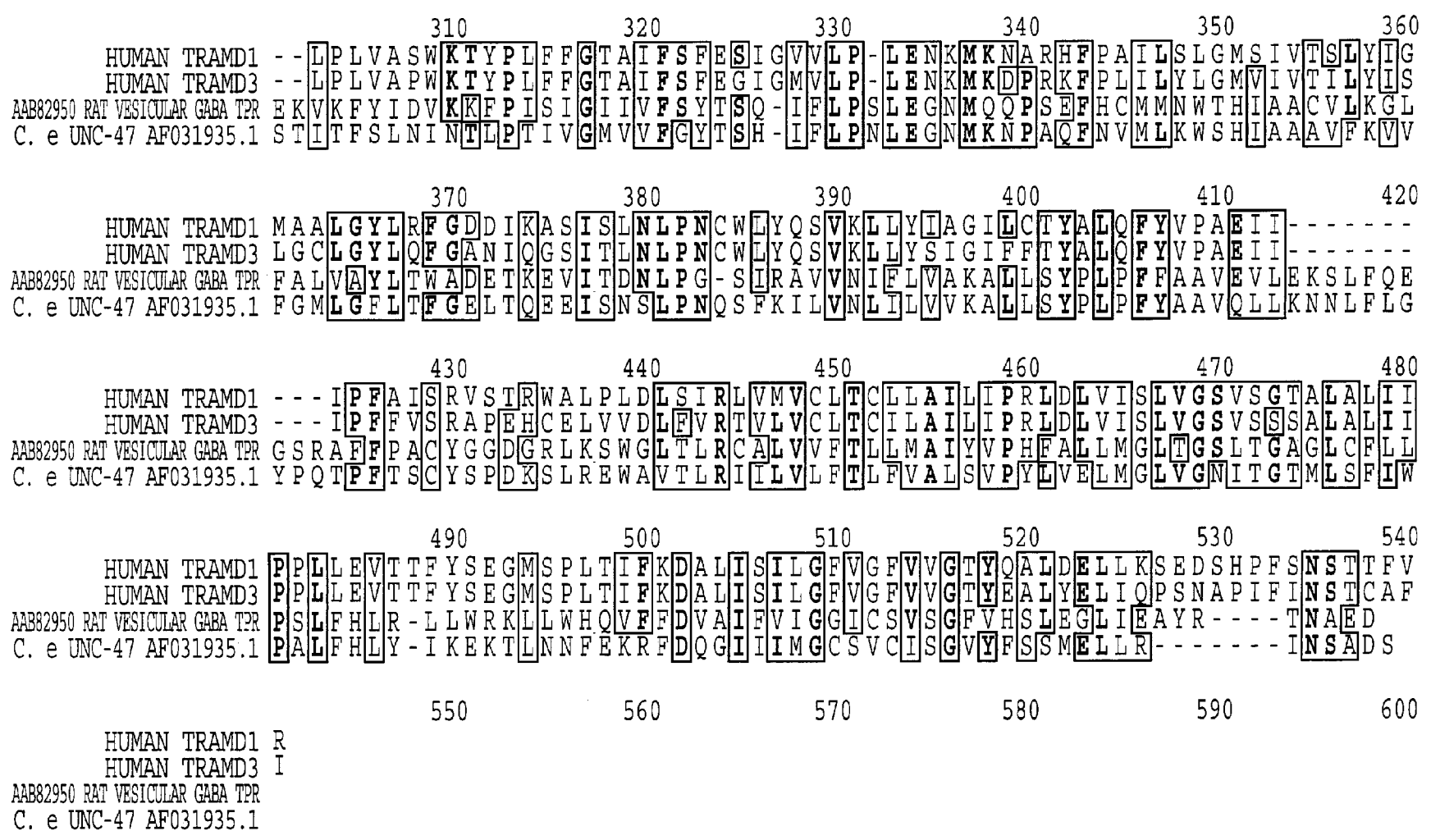

FIG. 15A-B depicts the conservation between human tramd 1 (SEQ ID NO:19), human tramd 3 (SEQ ID NO:21), and a rat (SEQ ID NO:36), confirmed experimentally, and *C. elegans* (SEQ ID NO:37), based on homology, VGAT.

FIG. 17 depicts the conservation between human (SEQ ID NO:21) and mouse tramd 3 (SEQ ID NO:18) proteins.

FIG. 18A and FIG. 18B depict the composite human tramd 3 cDNA sequence (SEQ ID NO:5) and the corresponding amino acid sequence (SEQ ID NO:21).

FIG. 19A and FIG. 19B depict the composite mouse tramdorin 2 cDNA (SEQ ID NO:1) sequence and the corresponding amino acid sequence (SEQ ID NO:17).

FIGS. 20A-D depict mouse tramd3 cDNA sequences. FIG. 20A and FIG. 20B depict a composite mouse tramd 3 cDNA (SEQ ID NO:2). FIG. 20C depicts mouse tramd 3 3' RACE cDNA 58#37 (SEQ ID NO:39). FIG. 20D depicts mouse tramd 3 3' RACE cDNA 56#22 (SEQ ID NO:40).

FIG. 21A and FIG. 21B depict the rat LYAAT-1 mRNA, and its translation. FIG. 21A depicts the translation of rat LYAAT-1, Genebank Accesion No. AAK67316.1, (SEQ ID NO:41). FIG. 21B depicts the rat LYAAT-1, Genebank Accesion No. AF361239, mRNA (SEQ ID NO:42).

FIG. 22 depicts the tramdL EST cDNA 1388139 sequence (SEQ ID NO:23) and the corresponding amino acid sequence (SEQ ID NO: 71).

FIG. 23A and FIG. 23B depict the predicted cDNA sequence of a STK4/Mst-1/Krs-2-tramdL fusion containing 5' STK4 sequences not included in EST cDNA 1388139 (SEQ ID NO: 38) and the corresponding amino acid sequence (SEQ ID NO: 44).

FIGS. 24A-C depicts mouse Gcm2 and Pth cDNA sequences. FIG. 24A shows the mouse Gcm2 cDNA sequence, Accession AF081556 (SEQ ID NO:24). FIG. 24B shows mouse parathyroid hormone cDNA, Accession NM_02063 (SEQ ID NO:25). FIG. 24C depicts mouse parathyroid hormone precursor, exons 2, 3 and cDNA AF066075 (SEQ ID NO: 33).

FIG. 29 depicts the nucleic acid sequence of the mouse tramd1 probe (SEQ ID NO:71) used in the in situ hybridizations presented in FIG. 28.

FIG. 30 depicts the nucleic acid sequence of the mouse tramd2 probe (SEQ ID NO:72) used in the in situ hybridizations presented in FIG. 28.

FIG. 31 depicts the nucleic acid sequence of the mouse tramd3 probe (SEQ ID NO:73) used in the in situ hybridizations presented in FIG. 28.

DEFINITIONS

Figure 1A:
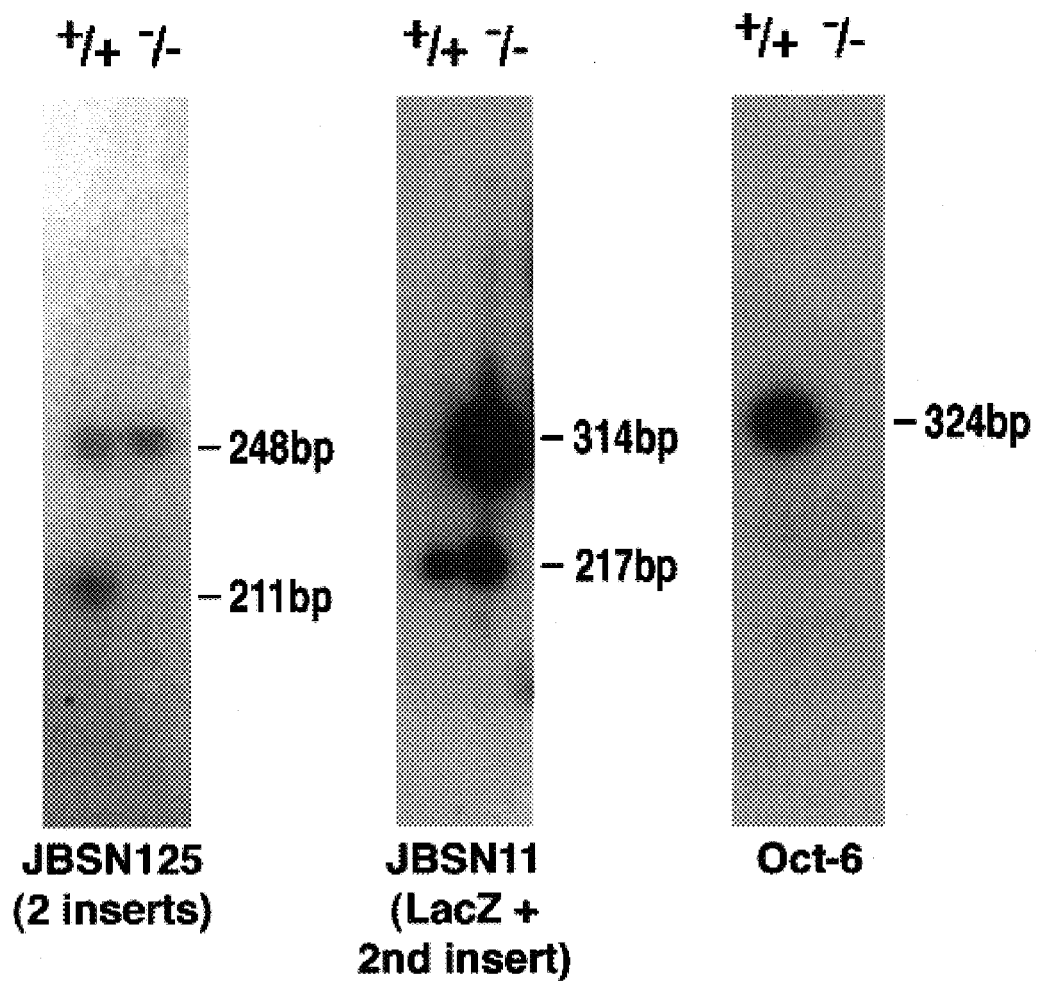
FIG. 1A and FIG. 1B show RDA clone JBSN125; a clone that contains two distinct sequences, one of which is differentially expressed in wild-type and Oct-6 (−/−) siatic nerve and is homologous to multiple EST cDNA's.

As used herein, "tramdorin", "tramd" or "tramdorins" and "tramds" refers to a family of related genes and related proteins that have been identified in at least human, mouse and rat. Tramdorin genes encode putative transmembrane proteins. At least four tramdorin family members exist: tramdorin 1 (tramd 1), tramdorin 2 (tramd2), tramdorin 3 (tramd3) and tramdL.

Tramdorin 1 has been identified in human, mouse and rat. The cDNA sequences for each are presented in FIG. 9A and FIG. 9B (putative cDNA for human tramdorin1 (SEQ ID NO:3)), FIGS. 2A-D (mouse tramdorin1 cDNA (SEQ ID NO:13)) and FIGS. 2A-D (putative rat tramdorin 1 cDNA (SEQ ID NO:6)). The mouse tramdorin 1 genomic sequence is presented in (SEQ ID NO:7). The genomic sequence for human tramdorin 1 (SEQ ID NO:9) is contained within the sequence presented in (SEQ ID NO:26). Specifically, the human tramdorin 1 gene is predicted to be contained within nucleotides 214333-256951 of SEQ ID NO:26, although it is also contemplated that additional regulatory sequences may lie outside of this span of nucleotides.

Tramd2 has been identified in human and mouse. The genomic sequence of human tramd 2 (SEQ ID NO:10) is contained within the sequence presented in (SEQ ID NO:26). Specifically, the human tramdorin 2 gene is predicted to be contained within nucleotides 258170-294569 of SEQ ID NO:26, although it is also contemplated that additional regulatory regions may lie outside of this span of nucleotides. The cDNA sequence encoding tramd2 in human is presented in FIGS. 10A-B (putative human tramd2 cDNA sequence (SEQ ID NO:4)) and the cDNA sequence encoding tramd 2 in mouse is presented in FIG. 19A and FIG. 19B (composite mouse tramdorin2 cDNA (SEQ ID NO:1)).

Figure 20A:
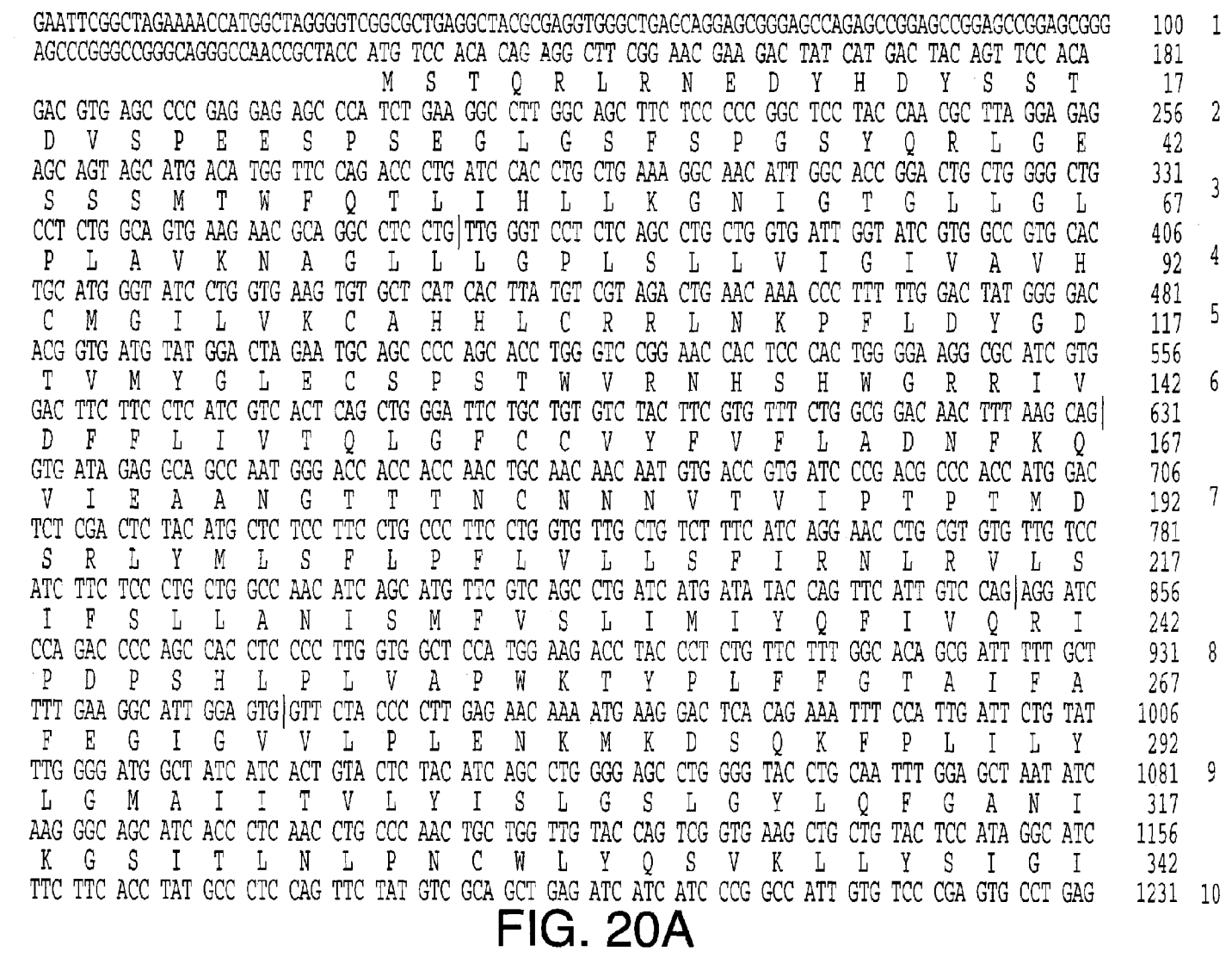

Tramdorin3 has also been identified in human, rat and mouse. The genomic sequence encoding tramd3 in human (SEQ ID NO:11) is contained in the sequence presented in (SEQ ID NO:26, the sequence between nucleotides 50001 and 300000 of *Homo Sapiens* chromosome 5 working draft sequence segment NT_006951.4) (note that tramd3 is shown in the antisense orientation in this figure). Specifically, the human tramdorin 3 gene is predicted to be contained within nucleotides 58749-136740 of SEQ ID NO:26, although it is also contemplated that additional regulatory regions may lie outside of this span of nucleotides. The genomic sequence encoding tramd 3 in mouse is shown in (SEQ ID NO:8) (genomic sequence of mouse tramdorin 3 (SEQ ID NO:8)). The cDNA sequence encoding human tramd 3 is presented in FIG. 18A and FIG. 18B (composite human tramd 3 cDNA (SEQ ID NO:5)). The coding region of the cDNA sequence encoding mouse tramd 3 is shown in FIGS. 20A-B (composite mouse tramd 3 cDNA (SEQ ID NO:2)). The mRNA sequence (SEQ ID NO:42), and its translation (SEQ ID NO:41), of rat LYAAT-1 (isolated by Sagne et al., *PNAS USA* 98:7206 (2001)), which appears to be a rat homolog of tramd 3 is presented in FIG. 21A and FIG. 21B.

Figure 5:
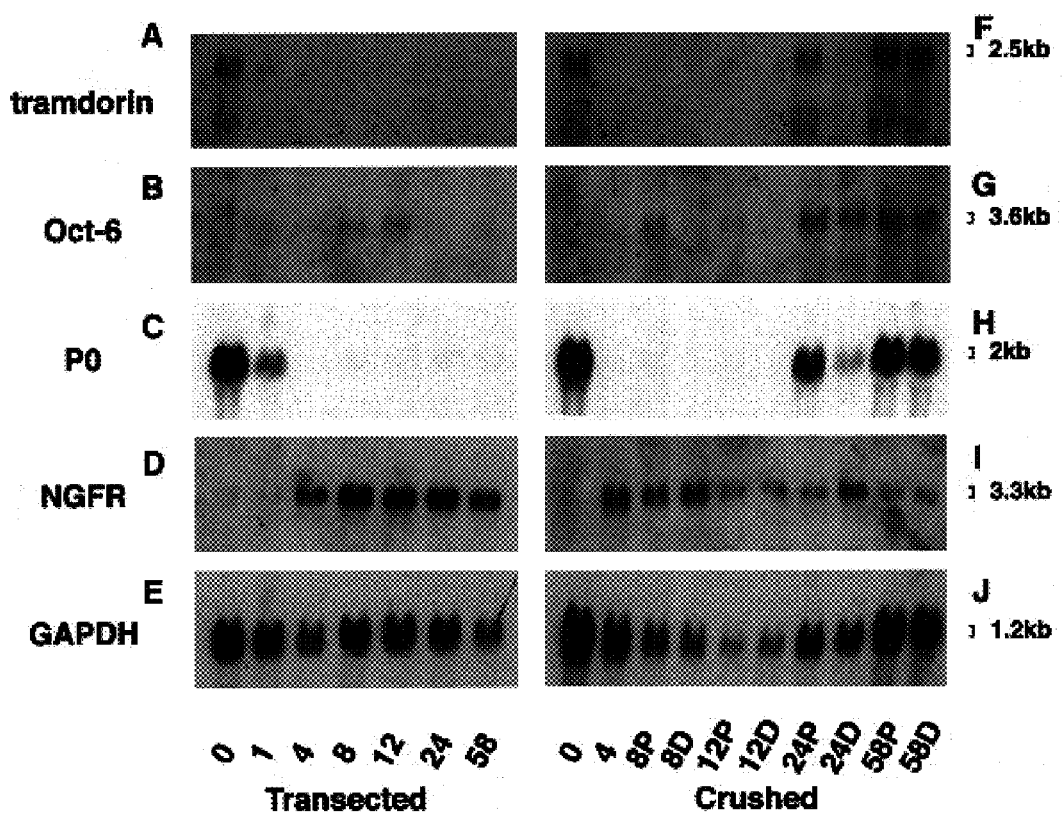
FIGS. 5A-J show Northern blots depicting the expression of tramdorin 1 and other genes at various times following nerve injury.
Figure 11A:
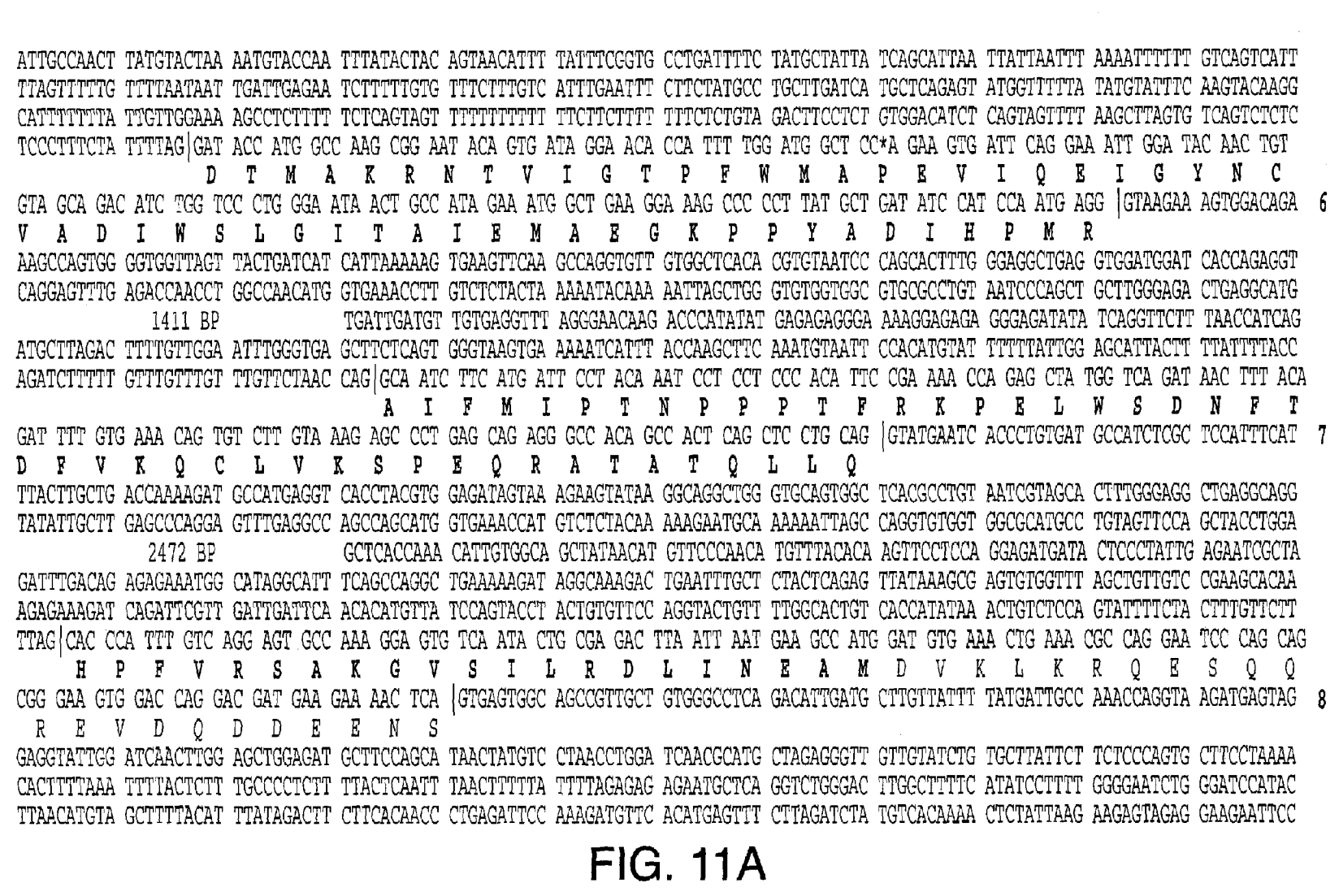
Figure 22:
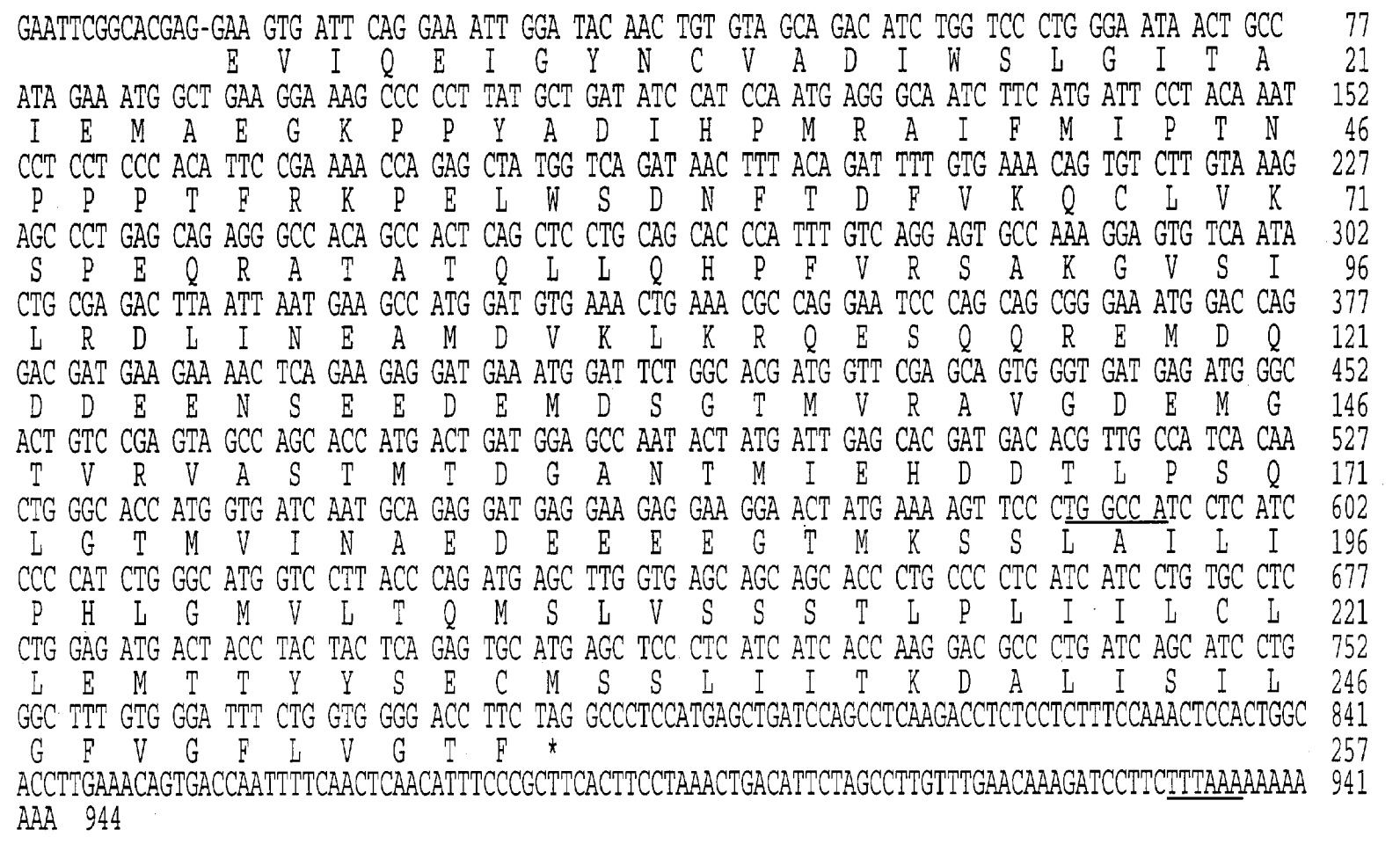

An additional tramdorin family member has been identified in human, tramdL, which exists as a splice junction fusion between a tramdorin 3' exon (SEQ ID NO:29) FIG. 11C and 5' STK4/Mst-1/Krs-2 sequences encoded on human chromosome 20 (SEQ ID NO:27) FIGS. 11A-B. The cDNA sequence of the fusion junction is shown in FIG. 11D (SEQ ID NO:31), and the putative STK4/Mst-1/Krs-2-tramdL fusion protein is depicted in FIG. 11E. The cDNA sequence of EST cDNA 1388139 (SEQ ID NO:23) is depicted in FIG. 22, as is the corresponding predicted amino acid sequence (SEQ ID NO:71).

With respect to nucleic acid sequences, one of skill in the art will appreciate that polymorphisms are often found in populations, and any such polymorphisms contained within any of the tramdorin genomic or cDNA sequences are also within the scope of the present invention.

The predicted proteins encoded by human tramdorins 1 (SEQ ID NO:19), 2 (SEQ ID NO:20) and 3 (SEQ ID NO:21) are depicted in FIGS. 13A-B. The putative amino acid sequence encoded by mouse tramd1 cDNA is depicted in FIG. 3A (SEQ ID NO:14). The amino acid sequences for human (SEQ ID NO:21) and mouse (SEQ ID NO:18) tramd3 proteins are shown in FIG. 17. In addition to the human, rat and mouse tramdorins described above, tramdorins appear to exist in other species. For example, homologous sequences have been identified in *Drosophila melanogaster* FIGS. 14A-B and *Caenorhabditis elegans* FIG. 14A-B. Thus one of skill in the art will understand that tramdorin family members may be identified based on homology to the sequences described above.

The putative amino acid sequence (corresponding to the sequence labeled "1920303" in FIG. 3A) encoded by mouse tramd1 cDNA is depicted in FIG. 3A (SEQ ID NO:14). This sequence has been assigned GenBank accession number AF12429. That is to say, the amino acid sequence referenced by GenBank accession number AF12429 is identical to the sequence labeled "1920303" in FIG. 3A. This mouse cDNA encodes a 478AA protein.

The amino acid sequences for human (SEQ ID NO:21) and mouse (SEQ ID NO:18) tramd3 proteins are shown in FIG. 17. In addition to the human, rat and mouse tramdorins described above, tramdorins appear to exist in other species. For example, homologous sequences have been identified in *Drosophila melanogaster* FIGS. 14A-B and *Caenorhabditis elegans* FIGS. 14A-B. Thus one of skill in the art will understand that tramdorin family members may be identified based on homology to the sequences described above.

As used herein, "derivatives" of tramdorin proteins can refer to a number of alterations in such proteins. In some embodiments, the derivatives comprise proteins with amino acid sequence changes. Such changes can be conservative amino acid substitutions, amino acid deletions or amino acid insertions, provided that the activity of the tramdorin is retained. Preferably, the alterations are conservative amino acid changes. For example, it is contemplated that an isolated replacement of a leucine with an isoleucine or valine, an alanine with a glycine, a threonine with a serine or a similar replacement of an amino acid with a structurally related amino acid (i.e. conservative substitutions) will not have a major effect on the biological activity of the resulting molecule. Conservative substitutions are those that take place within a family of amino acids that are related by their side chains. Amino acids can be divided into four families: (1) acidic (aspartate, glutamate); (2) basic (lysine, arginine, histidine); (3) nonpolar (alanine, valine, leucine, isoleucine, proline, phenylalanine, methionine, tryptophan); and (4) uncharged polar (glycine, asparagine, glutamine, cysteine, serine, threonine, tyrosine). Phenylalanine, tryptophan, and tyrosine are sometimes classified jointly as aromatic amino acids. In an alternative, yet similar fashion, the amino acid repertoire can be grouped as: (1) acidic (aspartate, glutamate); (2) basic (lysine, arginine, histidine); (3) aliphatic (glycine, alanine, valine, leucine, isoleucine, serine, threonine), with serine and threonine optionally grouped separately as aliphatic-hydroxyl; (4) aromatic (phenylalanine, tyrosine, tryptophan); (5) amide (asparagine, glutamine); and (6) sulfur-containing (cysteine and methionine) (See e.g. Stryer ed., Biochemistry, 2E, WH Freeman and Co. (1981) pp. 13-16). Thus, in certain embodiments, modifications of the tramdorin protein sequence(s) is contemplated by the present invention. Guidance in determining which and how many amino acid residues may be substituted, inserted, or deleted without abolishing biological activity may be found by using computer programs well known in the art, for example, DNAStar software or GCG (Univ. of Wisconsin).

As used herein, "central nervous system", or "CNS" refers to the brain and spinal cord. The tissues of the CNS comprise both neurons and accessory, or "glial" cells. The accessory cells of the CNS are referred to as "oligodendrocytes", which form insulating myelin sheaths around the axons of many neurons, and "astrocytes" which provide structural and metabolic support for neurons and also induce tight junctions between cells lining the capillaries in the brain.

As used herein, the "peripheral nervous system", or "PNS" refers to the nerves and supporting cells that communicate motor and sensory signals between the CNS and the rest of the body. The supporting cells of the PNS are referred to as "Schwann cells", which form the insulating myelin sheaths around the axons of many neurons.

As used herein, "myelin" refers to the lipoproteinaceous material, composed of regularly alternating membranes of lipid lamellae (consisting of cholesterol, phospholipids, sphingolipids, phosphatidates) and protein, of the myelin sheath.

As used herein, the term "demyelinating disease" refers to any pathological process that results in the degradation or loss of the myelin sheath surrounding an axon, including, but not limited to Multiple Sclerosis, Charcot-Marie Tooth (CMT) and Guillain-Barre syndrome.

As used herein, the term "gene" refers to a DNA sequence that comprises control and coding sequences necessary for the production of a polypeptide or protein precursor. The polypeptide can be encoded by a full length coding sequence or by any portion of the coding sequence, as long as the desired protein activity is retained.

"Nucleoside", as used herein, refers to a compound consisting of a purine (guanine (G) or adenine (A)) or pyrimidine (thymine (T), uridine (U), or cytidine (C)) base covalently linked to a pentose, whereas "nucleotide" refers to a nucleoside phosphorylated at one of its pentose hydroxyl groups;

A "nucleic acid", as used herein, is a covalently linked sequence of nucleotides in which the 3' position of the pentose of one nucleotide is joined by a phosphodiester group to the 5' position of the pentose of the next, and in which the nucleotide residues (bases) are linked in specific sequence; i.e., a linear order of nucleotides. A "polynucleotide", as used herein, is a nucleic acid containing a sequence that is greater than about 100 nucleotides in length. An "oligonucleotide", as used herein, is a short polynucleotide or a portion of a polynucleotide. An oligonucleotide typically contains a sequence of about two to about one hundred bases. The word "oligo" is sometimes used in place of the word "oligonucleotide". Nucleic acid molecules are said to have a "5'-terminus" (5' end) and a "3'-terminus" (3' end) because nucleic acid phosphodiester linkages occur to the 5' carbon and 3' carbon of the pentose ring of the substituent mononucleotides. The end of a nucleic acid at which a new linkage would be to a 5' pentose carbon is its 5' terminal nucleotide (by convention sequences are written, from right to left, in the 5' to 3' direction). The end of a nucleic acid at which a new linkage would be to a 3' pentose carbon is its 3' terminal nucleotide. A terminal nucleotide, as used herein, is the nucleotide at the end position of the 3'- or 5'-terminus. DNA molecules are said to have "5'ends" and "3'ends" because mononucleotides are reacted to make oligonucleotides in a manner such that the 5' phosphate of one mononucleotide pentose ring is attached to the 3' oxygen of its neighbor in one direction via a phosphodiester linkage. Therefore, an end of an oligonucleotide is referred to as the "5' end" if its 5' phosphate is not linked to the 3' oxygen of a mononucleotide pentose ring and as the "3' 7 end" if its 3' oxygen is not linked to a 5' phosphate of a subsequent mononucleotide pentose ring.

As used herein, a nucleic acid sequence, even if internal to a larger oligonucleotide or polynucleotide, also may be said to have 5' and 3' ends. In either a linear or circular DNA molecule, discrete elements are referred to as being "upstream" or 5' of the "downstream" or 3' elements. This terminology reflects the fact that transcription proceeds in a 5' to 3' fashion along the DNA strand. Typically, promoter and enhancer elements that direct transcription of a linked gene are generally located 5' or upstream of the coding region. However, enhancer elements can exert their effect even when located 3' of the promoter element and the coding region. Transcription termination and polyadenylation signals are located 3' or downstream of the coding region.

The term "wild-type" when made in reference to a gene refers to a gene which has the characteristics of a gene isolated from a naturally occurring source. The term "wild-type" when made in reference to a gene product refers to a gene product which has the characteristics of a gene product isolated from a naturally occurring source. A wild-type gene is that which is most frequently observed in a population and is thus arbitrarily designated the "normal" or "wild-type" form of the gene. In contrast, the term "modified" or "mutant" when made in reference to a gene or to a gene product refers, respectively, to a gene or to a gene product which displays modifications in sequence and/or functional properties (i.e., altered characteristics) when compared to the wild-type gene or gene product. It is noted that naturally-occurring mutants can be isolated; these are identified by the fact that they have altered characteristics when compared to the wild-type gene or gene product. For some variants (i.e. modified or mutant forms of a gene), there is no selection against individuals carrying the variant form, and so both forms (wild-type and modified) may be relatively common in the general population. This is referred to as "genetic polymorphism", which is defined herein as a genetic variation in which the frequency of two or more forms, or alleles, is at least 1% in the population. Polymorphisms within the tramdorin sequences are specifically contemplated.

As used herein in reference to a nucleic acid sequence (for example a cDNA or genomic sequence), the term "portion" (as in "a portion of a genomic sequence") refers to fragments of that nucleic acid sequence. The fragments may range in size from five nucleotides to the entire nucleic acid sequence minus one nucleotide.

The term "antisense" as used herein refers to a deoxyribonucleotide sequence whose sequence of deoxyribonucleotide residues is in reverse 5' to 3' orientation in relation to the sequence of deoxyribonucleotide residues in a sense strand of a DNA duplex. Antisense also refers to the "reverse complement orientation". By way of example, the reverse complement of the nucleotide sequence 5' GATCC-3' is 5'-CTAGG-3'. A "sense strand" of a DNA duplex refers to a strand in a DNA duplex which is transcribed by a cell in its natural state into a "sense mRNA." Thus an "antisense" sequence is a sequence having the same sequence as the non-coding strand in a DNA duplex. The term "antisense RNA" refers to a RNA transcript that is complementary to all or part of a target primary transcript or mRNA and that blocks the expression of a target gene by interfering with the processing, transport and/or translation of its primary transcript or mRNA. The complementarity of an antisense RNA may be with any part of the specific gene transcript, i.e., at the 5' non-coding sequence, 3' non-coding sequence, introns, or the coding sequence. In addition, as used herein, antisense RNA may contain regions of ribozyme sequences that increase the efficacy of antisense RNA to block gene expression. "Ribozyme" refers to a catalytic RNA and includes sequence-specific endoribonucleases. "Antisense inhibition" refers to the production of antisense RNA transcripts capable of preventing the expression of the target protein.

As used herein, the term "overexpression" refers to the production of a gene product in transgenic organisms that exceeds levels of production in normal or non-transformed organisms. As used herein, the term "altered levels" refers to the production of gene product(s) in transgenic organisms in amounts or proportions that differ from that of normal or non-transformed organisms.

The term "recombinant" when made in reference to a DNA molecule refers to a DNA molecule which is comprised of segments of DNA joined together by means of molecular biological techniques. The term "recombinant" when made in reference to a protein or a polypeptide refers to a protein molecule which is expressed using a recombinant DNA molecule.

The term "nucleotide sequence of interest" refers to any nucleotide sequence, the manipulation of which may be deemed desirable for any reason (e.g., confer improved qualities), by one of ordinary skill in the art. Such nucleotide sequences include, but are not limited to, coding sequences of structural genes (e.g., reporter genes, selection marker genes, oncogenes, drug resistance genes, growth factors, etc.), and non-coding regulatory sequences which do not encode an mRNA or protein product, (e.g., promoter sequence, polyadenylation sequence, termination sequence, enhancer sequence, etc.).

As used herein the term "coding region" when used in reference to structural gene refers to the nucleotide sequences which encode the amino acids found in the nascent polypeptide as a result of translation of a mRNA molecule. Typically, the coding region is bounded on the 5' side by the nucleotide triplet "ATG" which encodes the initiator methionine and on the 3' side by a stop codon (e.g., TAA, TAG, TGA). In some cases the coding region is also known to initiate by a nucleotide triplet "TTG".

As used herein, the terms "complementary" or "complementarity" when used in reference to polynucleotides refer to polynucleotides which are related by the base-pairing rules. For example, for the sequence 5'-AGT-3' is complementary to the sequence 5'-ACT-3'. Complementarity may be "partial," in which only some of the nucleic acids' bases are matched according to the base pairing rules. Or, there may be "complete" or "total" complementarity between the nucleic acids. The degree of complementarity between nucleic acid strands has significant effects on the efficiency and strength of hybridization between nucleic acid strands. This is of particular importance in amplification reactions, as well as detection methods which depend upon binding between nucleic acids.

A "complement" of a nucleic acid sequence as used herein refers to a nucleotide sequence whose nucleic acids show total complementarity to the nucleic acids of the nucleic acid sequence.

The term "homology" when used in relation to nucleic acids refers to a degree of complementarity. There may be partial homology or complete homology (i.e., identity). "Sequence identity" refers to a measure of relatedness between two or more nucleic acids or proteins, and is given as a percentage with reference to the total comparison length. The identity calculation takes into account those nucleotide or amino acid residues that are identical and in the same relative positions in their respective larger sequences. Calculations of identity may be performed by algorithms contained within computer programs such as "GAP" (Genetics Computer Group, Madison, Wis.) and "ALIGN" (DNAStar, Madison, Wis.). A partially complementary sequence is one that at least partially inhibits (or competes with) a completely complementary sequence from hybridizing to a target nucleic acid is referred to using the functional term "substantially homologous." The inhibition of hybridization of the completely complementary sequence to the target sequence may be examined using a hybridization assay (Southern or Northern blot, solution hybridization and the like) under conditions of low stringency. A substantially homologous sequence or probe will compete for and inhibit the binding (i.e., the hybridization) of a sequence which is completely homologous to a target under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target which lacks even a partial degree of complementarity (e.g., less than about 30% identity); in the absence of non-specific binding the probe will not hybridize to the second non-complementary target.

When used in reference to a double-stranded nucleic acid sequence such as a cDNA or genomic clone, the term "substantially homologous" refers to any probe which can hybridize to either or both strands of the double-stranded nucleic acid sequence under conditions of low stringency as described infra.

Low stringency conditions when used in reference to nucleic acid hybridization comprise conditions equivalent to binding or hybridization at 42° C. in a solution consisting of 5×SSPE (43.8 g/l NaCl, 6.9 g/l $NaH_2PO_4.H_2O$ and 1.85 g/l EDTA, pH adjusted to 7.4 with NaOH), 0.1% SDS, 5× Denhardt's reagent (50× Denhardt's contains per 500 ml: 5 g Ficoll (Type 400, Pharmacia), 5 g BSA (Fraction V; Sigma)) and 100 µg/ml denatured salmon sperm DNA followed by washing in a solution comprising 5×SSPE, 0.1% SDS at 42° C. when a probe of about 500 nucleotides in length is employed.

High stringency conditions when used in reference to nucleic acid hybridization comprise conditions equivalent to binding or hybridization at 42° C. in a solution consisting of 5×SSPE (43.8 g/l NaCl, 6.9 g/l $NaH_2PO_4.H_2O$ and 1.85 g/l EDTA, pH adjusted to 7.4 with NaOH), 0.5% SDS, 5× Denhardt's reagent and 100 µg/ml denatured salmon sperm DNA followed by washing in a solution comprising 0.1× SSPE, 1.0% SDS at 42° C. when a probe of about 500 nucleotides in length is employed.

When used in reference to nucleic acid hybridization the art knows well that numerous equivalent conditions may be employed to comprise either low or high stringency conditions; factors such as the length and nature (DNA, RNA, base composition) of the probe and nature of the target (DNA, RNA, base composition, present in solution or immobilized, etc.) and the concentration of the salts and other components (e.g., the presence or absence of formamide, dextran sulfate, polyethylene glycol) are considered and the hybridization solution may be varied to generate conditions of either low or high stringency hybridization different from, but equivalent to, the above listed conditions.

"Stringency" when used in reference to nucleic acid hybridization typically occurs in a range from about $T_m-5°$ C. (5° C. below the $T_m$ of the probe) to about 20° C. to 25° C. below $T_m$. As will be understood by those of skill in the art, a stringent hybridization can be used to identify or detect identical polynucleotide sequences or to identify or detect similar or related polynucleotide sequences. Under "stringent conditions" a nucleic acid sequence of interest will hybridize to its exact complement and closely related sequences.

Polypeptide molecules are said to have an "amino terminus" (N-terminus) and a "carboxy terminus" (C-terminus) because peptide linkages occur between the backbone amino group of a first amino acid residue and the backbone carboxyl group of a second amino acid residue. Typically, the terminus of a polypeptide at which a new linkage would be to the carboxy-terminus of the growing polypeptide chain, and polypeptide sequences are written from left to right beginning at the amino terminus.

As used herein in reference to an amino acid sequence or a protein, the term "portion" (as in "a portion of an amino acid sequence") refers to fragments of that protein. The fragments may range in size from four amino acid residues to the entire amino acid sequence minus one amino acid.

As used herein, the term "fusion protein" refers to a chimeric protein containing the protein of interest (e.g., tramdorins and fragments thereof) joined to an exogenous protein fragment (e.g., the fusion partner which consists of a non-tramdorin protein). The fusion partner may enhance the solubility of tramdorin protein as expressed in a host cell, may provide an affinity tag to allow purification of the recombinant fusion protein from the host cell or culture supernatant, or both. The fusion partner may also enable screening assays, such as the yeast two-hybrid assay. If desired, the fusion protein may be removed from the protein of interest (e.g., tramdorins or fragments thereof) by a variety of enzymatic or chemical means known to the art.

The term "isolated" when used in relation to a nucleic acid, as in "an isolated nucleic acid sequence" refers to a nucleic acid sequence that is identified and separated from at least one contaminant nucleic acid with which it is ordinarily associated in its natural source. Isolated nucleic acid is nucleic acid present in a form or setting that is different from that in which it is found in nature. In contrast, non-isolated nucleic acids are nucleic acids such as DNA and RNA which are found in the state they exist in nature. For example, a given DNA sequence (e.g., a gene) is found on the host cell chromosome in proximity to neighboring genes; RNA sequences, such as a specific mRNA sequence encoding a specific protein, are found in the cell as a mixture with numerous other mRNAs which encode a multitude of proteins. However, an isolated nucleic acid sequence encoding human tramdorin 1 (for example) includes, by way of example, such nucleic acid sequences in cells which ordinarily contain the sequence encoding human tramdorin 1, where the nucleic acid sequence is in a chromosomal or extrachromosomal location different from that of natural cells, or is otherwise flanked by a different nucleic acid sequence than that found in nature. The isolated nucleic acid sequence may be present in single-stranded or double-stranded form. When an isolated nucleic acid sequence is to be utilized to express a protein, the nucleic acid sequence will contain at a minimum at least a portion of the sense or coding strand (i.e., the nucleic acid sequence may be single-stranded). Alternatively, it may contain both the sense and anti-sense strands (i.e., the nucleic acid sequence may be double-stranded).

As used herein, the term "purified" refers to molecules, either nucleic or amino acid sequences, that are removed from their natural environment, isolated or separated. An "isolated nucleic acid sequence" is therefore a purified nucleic acid sequence. "Substantially purified" molecules are at least 60% free, preferably at least 75% free, and more preferably at least 90% free from other components with which they are naturally associated.

As used herein, the terms "vector" and "vehicle" are used interchangeably in reference to nucleic acid molecules that transfer DNA segment(s) from one cell to another. Vectors may include plasmids, bacteriophages, viruses, cosmids, and the like.

The term "expression vector" or "expression cassette" as used herein refers to a recombinant DNA molecule containing a desired coding sequence and appropriate nucleic acid sequences necessary for the expression of the operably linked coding sequence in a particular host organism. Nucleic acid sequences necessary for expression in prokaryotes usually include a promoter, an operator (optional), and a ribosome binding site, often along with other sequences. Eukaryotic cells are known to utilize promoters, enhancers, and termination and polyadenylation signals.

The terms "targeting vector" and "targeting construct" refer to nucleic acid sequences comprising a sequence of interest flanked on either side by recognition sequences that are capable of homologous recombination with cognate sequences in the genome in such a way that the sequence of interest replaces any DNA sequences that are located between the cognate sequences in the genome. The sequence of interest can consist of recognition sites for restriction enzymes or site specific recombinases such as Flp or Cre, exongenous genes including but not limited to those that encode thymidinekinase or confer resistance to antibiotics such as neomycin and hygromycin, marker genes such as LacZ and eGFP, as well as portions of the targeted gene itself or sequences from other genes of interest.

The terms "in operable combination", "in operable order" and "operably linked" as used herein refer to the linkage of nucleic acid sequences in such a manner that a nucleic acid molecule capable of directing the transcription of a given gene and/or the synthesis of a desired protein molecule is produced. The term also refers to the linkage of amino acid sequences in such a manner so that a functional protein is produced.

The term "selectable marker" as used herein, refer to a gene which encodes an enzyme having an activity that confers resistance to an antibiotic or drug upon the cell in which the selectable marker is expressed. Selectable markers may be "positive" or "negative." Examples of positive selectable markers include the neomycin phosphotrasferase (NPTII) gene which confers resistance to G418 and to kanamycin, and the bacterial hygromycin phosphotransferase gene (hyg), which confers resistance to the antibiotic hygromycin. Negative selectable markers encode an enzymatic activity whose expression is cytotoxic to the cell when grown in an appropriate selective medium. For example, the HSV-tk gene is commonly used as a negative selectable marker. Expression of the HSV-tk gene in cells grown in the presence of gancyclovir or acyclovir is cytotoxic; thus, growth of cells in selective medium containing gancyclovir or acyclovir selects against cells capable of expressing a functional HSV TK enzyme.

Transcriptional control signals in eukaryotes comprise "promoter" and "enhancer" elements. Promoters and enhancers consist of short arrays of DNA sequences that interact specifically with cellular proteins involved in transcription (Maniatis, et al., *Science* 236:1237, 1987). Promoter and enhancer elements have been isolated from a variety of eukaryotic sources including genes in yeast, insect, mammalian and plant cells. Promoter and enhancer elements have also been isolated from viruses and analogous control elements, such as promoters, are also found in prokaryotes. The selection of a particular promoter and enhancer depends on the cell type used to express the protein of interest. Some eukaryotic promoters and enhancers have a broad host range while others are functional in a limited subset of cell types (for review, see Voss, et al., Trends Biochem. Sci., 11:287, 1986; and Maniatis, et al., supra 1987).

The terms "promoter element," "promoter," or "promoter sequence" as used herein, refer to a DNA sequence that is located at the 5' end (i.e. precedes) the protein coding region of a DNA polymer. The location of most promoters known in nature precedes the transcribed region. The promoter functions as a switch, activating the expression of a gene. If the gene is activated, it is said to be transcribed, or participating in transcription. Transcription involves the synthesis of mRNA from the gene. The promoter, therefore, serves as a transcriptional regulatory element and also provides a site for initiation of transcription of the gene into mRNA.

Promoters may be tissue specific or cell specific. The term "tissue specific" as it applies to a promoter refers to a promoter that is capable of directing selective expression of a nucleotide sequence of interest to a specific type of tissue in the relative absence of expression of the same nucleotide sequence of interest in a different type of tissue. Tissue specificity of a promoter may be evaluated by, for example, operably linking a reporter gene to the promoter sequence to generate a reporter construct, introducing the reporter construct into the genome of an organism such that the reporter construct is integrated into every tissue of the resulting transgenic organism, and detecting the expression of the reporter gene (e.g., detecting mRNA, protein, or the activity of a protein encoded by the reporter gene) in different tissues of the transgenic. The detection of a greater level of expression of the reporter gene in one or more tissues relative to the level of expression of the reporter gene in other tissues shows that the promoter is specific for the tissues in which greater levels of expression are detected. The term "cell type specific" as applied to a promoter refers to a promoter which is capable of directing selective expression of a nucleotide sequence of interest in a specific type of cell in the relative absence of expression of the same nucleotide sequence of interest in a different type of cell within the same tissue. The term "cell type specific" when applied to a promoter also means a promoter capable of promoting selective expression of a nucleotide sequence of interest in a region within a single tissue. Cell type specificity of a promoter may be assessed using methods well known in the art, e.g., immunohistochemical staining. Briefly, tissue sections are embedded in paraffin, and paraffin sections are reacted with a primary antibody which is specific for the polypeptide product encoded by the nucleotide sequence of interest whose expression is controlled by the promoter. A labeled (e.g., peroxidase conjugated) secondary antibody which is specific for the primary antibody is allowed to bind to the sectioned tissue and specific binding detected (e.g., with avidin/biotin) by microscopy. Alternatively, mRNA localization can be determined by in situ hybridization.

Promoters may be constitutive or regulatable. The term "constitutive" when made in reference to a promoter means that the promoter is capable of directing transcription of an operably linked nucleic acid sequence in the absence of a stimulus (e.g., heat shock, chemicals, light, etc.). Typically, constitutive promoters are capable of directing expression of a transgene in substantially any cell and any tissue.

In contrast, a "regulatable" promoter is one which is capable of directing a level of transcription of an operably linked nuclei acid sequence in the presence of a stimulus (e.g., heat shock, chemicals, light, etc.) which is different from the level of transcription of the operably linked nucleic acid sequence in the absence of the stimulus.

As used herein, the term "regulatory element" refers to a genetic element that controls some aspect of the expression of nucleic acid sequence(s). For example, a promoter is a regulatory element that facilitates the initiation of transcription of an operably linked coding region. Other regulatory elements are splicing signals, polyadenylation signals, termination signals, etc.

The enhancer and/or promoter may be "endogenous" or "exogenous" or "heterologous." An "endogenous" enhancer or promoter is one that is naturally linked with a given gene in the genome. An "exogenous" or "heterologous", enhancer or promoter is one that is placed in juxtaposition to a gene by means of genetic manipulation (i.e., molecular biological techniques) such that transcription of the gene is directed by the linked enhancer or promoter. For example, an endogenous promoter in operable combination with a first gene can be isolated, removed and placed in operable combination with a second gene, thereby making it a "heterologous" promoter in operable combination with said second gene. A variety of such combinations are contemplated (e.g. the first and second genes can be from the same species, or from different species).

The presence of "splicing signals" on an expression vector often results in higher levels of expression of the recombinant transcript in eukaryotic host cells. Splicing signals mediate the removal of introns from the primary RNA transcript and consist of a splice donor and acceptor site (Sambrook, et al., *Molecular Cloning: A Laboratory Manual*, 2nd ed., Cold Spring Harbor Laboratory Press, New York (1989) pp. 16.7-16.8). A commonly used splice donor and acceptor site is the splice junction from the 16S RNA of SV40.

Efficient expression of recombinant DNA sequences in eukaryotic cells requires expression of signals directing the efficient termination and polyadenylation of the resulting transcript. Transcription termination signals are generally found downstream of the polyadenylation signal and are a few hundred nucleotides in length. The term "poly(A) site" or "poly(A) sequence" as used herein denotes a DNA sequence which directs both the termination and polyadenylation of the nascent RNA transcript. Efficient polyadenylation of the recombinant transcript is desirable, as transcripts lacking a poly(A) tail are unstable and are rapidly degraded. The poly(A) signal utilized in an expression vector may be "heterologous" or "endogenous." An endogenous poly(A) signal is one that is found naturally at the 3' end of the coding region of a given gene in the genome. A heterologous poly(A) signal is one which has been isolated from one gene and positioned 3' to another gene. A commonly used heterologous poly(A) signal is the SV40 poly (A) signal. The SV40 poly(A) signal is contained on a 237 bp BamHI/BclI restriction fragment and directs both termination and polyadenylation (Sambrook, supra, at 16.6-16.7).

The term "transfection" as used herein refers to the introduction of foreign DNA into eukaryotic cells. Transfection may be accomplished by a variety of means known to the art including calcium phosphate-DNA co-precipitation, DEAE-dextran-mediated transfection, polybrene-mediated transfection, electroporation, microinjection, liposome fusion, lipofection, protoplast fusion, retroviral infection, and biolistics. When introducing foreign DNA into yeast cells, the term "transformation" is commonly used.

The term "transgenic" when used in reference to a cell refers to a cell which contains a transgene, or whose genome has been altered by the introduction of a transgene. The term "transgenic" when used in reference to a tissue or to an organism, such as a mouse, refers to a tissue or organism, respectively, which comprises one or more cells that contain a transgene, or whose genome has been altered by the introduction of a transgene. Transgenic cells, tissues and organisms may be produced by several methods including the introduction of a "transgene" comprising nucleic acid (usually DNA) into a target cell or integration of the transgene into a chromosome of a target cell by way of human intervention, such as by the methods described herein.

The term "transgene" as used herein refers to any nucleic acid sequence which is introduced into the genome of a cell by experimental manipulations. A transgene may be an "endogenous DNA sequence," or a "heterologous DNA sequence" (i.e., "foreign DNA"). The term "endogenous DNA sequence" refers to a nucleotide sequence which is naturally found in the cell into which it is introduced so long as it does not contain some modification (e.g., a point mutation, the presence of a selectable marker gene, etc.) relative to the naturally-occurring sequence. The term "heterologous DNA sequence" refers to a nucleotide sequence which is ligated to, or is manipulated to become ligated to, a nucleic acid sequence to which it is not ligated in nature, or to which it is ligated at a different location in nature. Heterologous DNA is not endogenous to the cell into which it is introduced, but has been obtained from another cell. Heterologous DNA also includes an endogenous DNA sequence which contains some modification. Generally, although not necessarily, heterologous DNA encodes RNA and proteins that are not normally produced by the cell into which it is expressed. Examples of heterologous DNA include reporter genes, transcriptional and translational regulatory sequences, selectable marker proteins (e.g., proteins which confer drug resistance), etc.

The term "foreign gene" refers to any nucleic acid (e.g., gene sequence) which is introduced into the genome of a cell by experimental manipulations and may include gene sequences found in that cell so long as the introduced gene contains some modification (e.g., a point mutation, the presence of a selectable marker gene, etc.) relative to the naturally-occurring gene.

Transformation of a cell may be stable or transient. The term "transient transformation" or "transiently transformed" refers to the introduction of one or more transgenes into a cell in the absence of integration of the transgene into the host cell's genome. Transient transformation may be detected by, for example, enzyme-linked immunosorbent assay (ELISA) which detects the presence of a polypeptide encoded by one or more of the transgenes. Alternatively, transient transformation may be detected by detecting the activity of the protein (e.g., β-glucuronidase) encoded by the transgene. The term "transient transformant" refers to a cell which has transiently incorporated one or more transgenes. In contrast, the term "stable transformation" or "stably transformed" refers to the introduction and integration of one or more transgenes into the genome of a cell. Stable transformation of a cell may be detected by Southern blot hybridization of genomic DNA of the cell with nucleic acid sequences which are capable of binding to one or more of the transgenes. Alternatively, stable transformation of a cell may also be detected by the polymerase chain reaction of genomic DNA of the cell to amplify transgene sequences. The term "stable transformant" refers to a cell which has stably integrated one or more transgenes into the genomic DNA. Thus, a stable transformant is distinguished from a transient transformant in that, whereas genomic DNA from the stable transformant contains one or more transgenes, genomic DNA from the transient transformant does not contain a transgene.

The term "amplification" is defined as the production of additional copies of a nucleic acid sequence and is generally carried out using polymerase chain reaction technologies well known in the art (Dieffenbach and G S Dvekler, *PCR Primer, a Laboratory Manual*, Cold Spring Harbor Press, Plainview N.Y. (1995)). As used herein, the term "polymerase chain reaction" ("PCR") refers to the methods disclosed in U.S. Pat. Nos. 4,683,195, 4,683,202 and 4,965,188, all of which are incorporated herein by reference, which describe a method for increasing the concentration of a segment of a target sequence in a mixture of genomic DNA without cloning or purification. This process for amplifying the target sequence consists of introducing a large excess of two oligonucleotide primers to the DNA mixture containing the desired target sequence, followed by a precise sequence of thermal cycling in the presence of a DNA polymerase. The two primers are complementary to their respective strands of the double stranded target sequence. To effect amplification, the mixture is denatured and the primers then annealed to their complementary sequences within the target molecule. Following annealing, the primers are extended with a polymerase so as to form a new pair of complementary strands. The steps of denaturation, primer annealing and polymerase extension can be repeated many times (i.e., denaturation, annealing and extension constitute one "cycle"; there can be numerous "cycles") to obtain a high concentration of an amplified segment of the desired target sequence. The length of the amplified segment of the desired target sequence is determined by the relative positions of the primers with respect to each other, and therefore, this length is a controllable parameter. By virtue of the repeating aspect of the process, the method is referred to as the "polymerase chain reaction" (hereinafter "PCR"). Because the desired amplified segments of the target sequence become the predominant sequences (in terms of concentration) in the mixture, they are said to be "PCR amplified."

With PCR, it is possible to amplify a single copy of a specific target sequence in genomic DNA to a level detectable by several different methodologies (e.g., hybridization with a labeled probe; incorporation of biotinylated primers followed by avidin-enzyme conjugate detection; and/or incorporation of $^{32}$P-labeled deoxyribonucleotide triphosphates, such as dCTP or dATP, into the amplified segment). In addition to genomic DNA, any oligonucleotide sequence can be amplified with the appropriate set of primer molecules. In particular, the amplified segments created by the PCR process itself are, themselves, efficient templates for subsequent PCR amplifications. Amplified target sequences may be used to obtain segments of DNA (e.g., genes) for the construction of targeting vectors, transgenes, etc.

As used herein, the term "sample template" refers to a nucleic acid originating from a sample which is analyzed for the presence of "target". In contrast, "background template" is used in reference to nucleic acid other than sample template, which may or may not be present in a sample. Background template is most often inadvertent. It may be the result of carryover, or it may be due to the presence of nucleic acid contaminants sought to be purified away from the sample. For example, nucleic acids other than those to be detected may be present as background in a test sample.

As used herein, the term "primer" refers to an oligonucleotide, whether occurring naturally (e.g., as in a purified restriction digest) or produced synthetically, which is capable of acting as a point of initiation of nucleic acid synthesis when placed under conditions in which synthesis of a primer extension product which is complementary to a nucleic acid strand is induced (i.e., in the presence of nucleotides, an inducing agent such as DNA polymerase, and under suitable conditions of temperature and pH). The primer is preferably single-stranded for maximum efficiency in amplification, but may alternatively be double-stranded. If double-stranded, the primer is first treated to separate its strands before being used to prepare extension products. Preferably, the primer is an oligodeoxyribonucleotide. The primer must be sufficiently long to prime the synthesis of extension products in the presence of the inducing agent. The exact lengths of the primers will depend on many factors, including temperature, source of primer and use of the method.

As used herein, the term "probe" refers to a polynucleotide sequence (for example an oligonucleotide), whether occurring naturally (e.g., as in a purified restriction digest) or produced synthetically, recombinantly or by PCR amplification, which is capable of hybridizing to another nucleic acid sequence of interest. A probe may be single-stranded or double-stranded. Probes are useful in the detection, identification and isolation of particular gene sequences. It is contemplated that the probe used in the present invention is labeled with any "reporter molecule," so that it is detectable in a detection system, including, but not limited to enzyme (i.e., ELISA, as well as enzyme-based histochemical assays), fluorescent, radioactive, and luminescent systems. It is not intended that the present invention be limited to any particular detection system or label. The terms "reporter molecule" and "label" are used herein interchangeably. In addition to probes, primers and deoxynucleoside triphosphates may contain labels; these labels may comprise, but are not limited to, $^{32}$P, $^{33}$P, $^{35}$S, enzymes, or fluorescent molecules (e.g., fluorescent dyes).

As used herein, "FISH" refers to fluorescence in situ hybridization, a technique in which detectably labeled DNA probes (which can be prepared, for example, from cDNA sequences or genomic sequences contained in cosmids or bacterial artificial chromosomes (BACs)) are hybridized to cytogenetic or histological specimens. Such specimens include, but are not limited to, metaphase chromosome spreads and interphase nuclei prepared from tissue or blood specimens, and formaldehyde-fixed, paraffin-embedded tissue sections. Fluorescent labels can be directly incorporated into the probe, or can be applied as antibody-label conjugates which bind to affinity labels (for example, biotin or digoxigenin) incorporated into the probe, either directly, or as an antibody "sandwich" (i.e. a primary and a secondary antibody). The fluorescent dyes include, but are not limited to rhodamine, texas red, FITC (fluorescein isothiocyanate) and TRITC (tetramethyl rhodamine isothiocyanate). The fluorescent labels are detected using a fluorescence microscope equipped with a mercury or xenon lamp (as an illumination source) and appropriate filters for excitation and emission. The pattern of fluorescence can be used to assess copy number of the locus recognized by the probe, or, in cases where two or more (differentially) labeled probes are used, to assess the relative positions of the probes (for example to detect chromosomal rearrangements, such as translocations and inversions).

As used herein, "parathyroid tumors" refers to tumors (benign or malignant) of the parathyroid gland. By way of example, a parathyroid adenoma is a benign tumor of the parathyroid gland. Other parathyroid tumors include parathyroid carcinomas.

As used herein, "parathyroid adenoma" refers to a benign tumor of a parathyroid gland. This enlargement and overactivity of the affected gland results in continued production of parathyroid hormone (hyperparathyroidism). In turn, elevated levels of calcium are found in the blood.

As used herein, the term "regulatory region of a gene expressed in the parathyroid" refers to the upstream regulatory sequences (including but not limited to promoter sequences) of a gene that is expressed primarily (if not exclusively) in the parathyroid gland. Such genes (and their regulatory regions) include, but are not limited to the parathyroid hormone gene and the Gcm2 gene. Such regulatory regions, when placed in operable combination with a sequence of interest will permit expression of the sequence of interest in a tissue-specific fashion in the parathyroid.

As used herein, "POU domain transcription factor" refers to a member of a family of transcription factors, characterized by possession of a bipartite DNA binding domain (the POU domain) that also provides binding sites for many proteins that interact with POU domains. POU domain transcription factors include, but are not limited to the transcription factor Oct-6 (also known as Tst-1 or SCIP).

Figure 12:
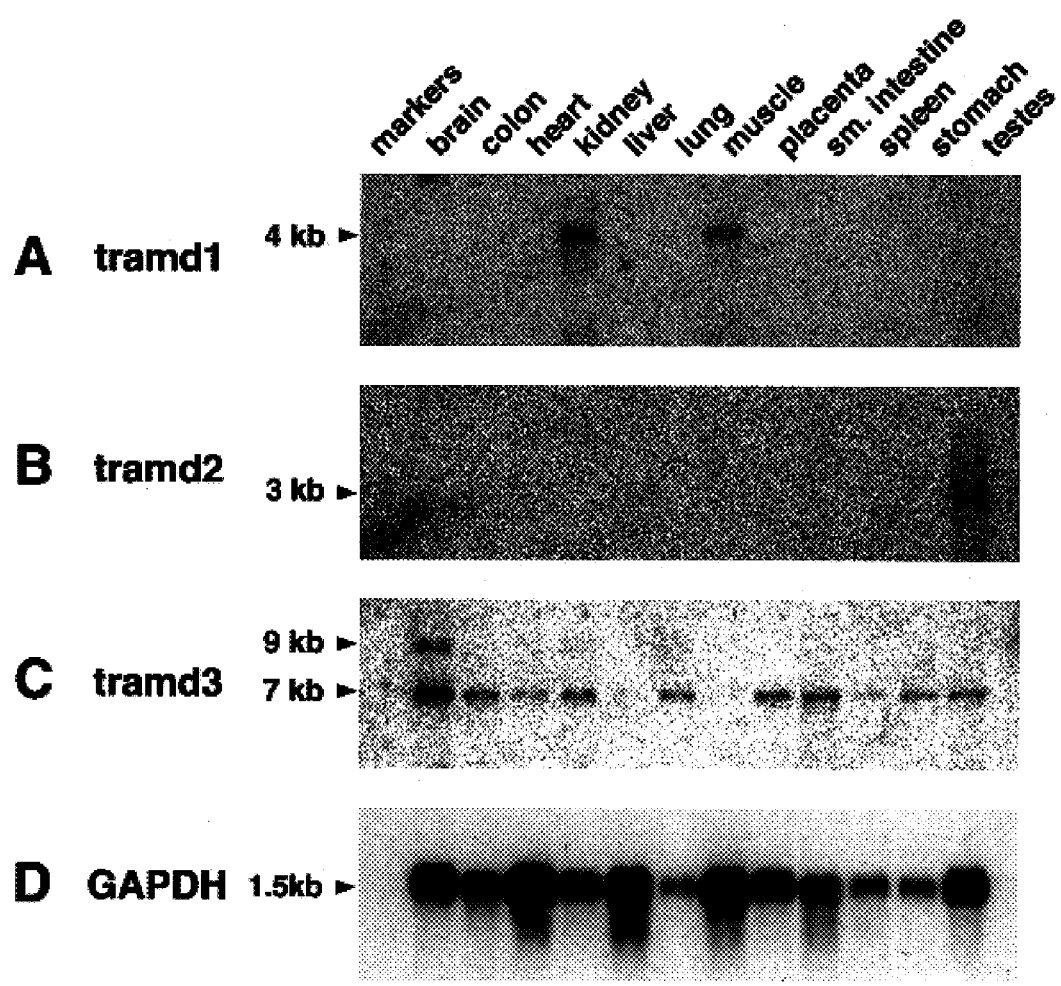
FIGS. 12A-D depict Northern blots of the tissue-specific expression of human tramdorin genes.

As used herein, a "STK4/Mst-1/Krs-2-tramd L fusion" or "STK4/Mst-1/Krs-2-tramdorin L fusion" refers to a fusion between tramdorin L sequences on human chromosome 5 and STK4/Mst-1/Krs-2 sequences on human chromosome 20. The fusion may be at the level of genomic sequences, or at the level of cDNA sequences, or both. The fusion involves at least the known exon of tramdL, as shown in FIG. 11C, and at least the genomic DNA encoding exons 6-9 of STK4/Mst-1/Krs-2, as shown in FIGS. 11A-B. STK4/Mst-1/Krs-2 is a member of the STE20 family of kinases. The STK4/Mst-1/Krs-2-tramd L fusion, as represented in EST cDNA 1388139 (SEQ ID NO:23), comprises the STK4/Mst-1/Krs-2 kinase domain sequences fused to 3' sequences of tramd L. A sequence of a representative STK4/Mst-1/Krs-2-tramdL fusion junction (in a cDNA) is shown in FIG. 11D (SEQ ID NO:31). The genomic sequences from the STK4/Mst-1/Krs-2 and tramdL partners of a representative fusion are shown in FIGS. 12A (SEQ ID NO:27) and 12B (SEQ ID NO:29), respectively. A predicted cDNA (SEQ ID NO:38) and protein sequence (SEQ ID NO:44) of a fusion containing additional 5' STK4 sequences not contained in EST cDNA 1388139 is provided in FIG. 23A and FIG. 23B.

As used herein, "NGFR" refers to a nerve growth factor receptor gene.

As used herein, "GADPH" refers to a glyceraldehydes-3-phosphate dehydrogenase gene.

As used herein, "Sos" (an acronym for "son-of-sevenless") refers to a ras guanine nucleotide exchange factor.

As used herein, "GABA" refers to γ-aminobutyric acid.

As used herein, "Gcm2" refers to the glial cells missing protein homolog (Gcm2) gene.

As used herein, the term "syntenic" refers to the preservation of "blocks" of genes in some fashion across species. That is, syntenic refers to a region of conserved synteny with another species, wherein "synteny" refers to the physical presence together on the same chromosome of two or more gene loci, whether or not they are close enough together for linkage to be demonstrated.

As used herein, the term "incisures" (also referred to as "Schmidt-Lanternan incisures"), are regions of non-compact myelin (i.e. regions of the myelin sheath that contain cytoplasm).

As used herein, the term "paranode" refers to a region adjacent to the node of Ranvier (i.e. the junction between adjacent myelin sheathes). The paranode contains a set of proteins that are not found in the node itself, or in the internode, the myelinated region between nodes. A single Schwann cell will contain half a node of Ranvier, a paranode, an internode, another paranode, and another half a node of Ranvier.

As used herein, "KLH" refers to the protein called Keyhole Limpet Hemocyanin.

DETAILED DESCRIPTION OF THE INVENTION

Mouse tramdorin 1 was identified in a screen for target genes of the POU domain transcription factor, Oct-6. Tramd1 encodes a putative transmembrane domain protein, and the expression pattern of tramd1 suggests that it is related to myelination in the peripheral nervous system. Homology searching identified tramdorin 1 homologues in human and rat, as well as identified a family of closely-related tramdorin genes, with at least four members. The location of the tramdorin gene cluster in humans is suggestive of a potential role in a peripheral neuropathy. One of the family members is present as a gene fragment, and may play a role in the etiology of the parathyroid tumors which is, in one embodiment, an adenoma. Compositions comprising the tramdorins (nucleic acid and amino acid sequences) and host cells transfected with tramdorins are contemplated. Additionally, the use of tramdorins in a variety of diagnostic assays is contemplated, as is the development of a transgenic mouse model for parathyroid tumors. The description of the invention includes I. The initial identification and characterization of mouse tramdorin 1, II. Identification of tramdorin homologs in mouse and other species, III. Organization of the tramdorin family locus in mouse and human, IV. Functional characterization of tramdorins V. Tramdorins and parathyroid tumors and VI. Tramdorins and peripheral neuropathies. VII. Remyelination by Schwann cells in the CNS following disease or injury.

I. The Initial Characterization of Mouse Tramdorin 1

Tramdorin 1 was identified in experiments directed to the study of myelination in the peripheral nervous system. Myelin sheathes are membranous structures that surround large caliber axons. By limiting axonal depolarization to the nodes of Ranvier that separate individual sheaths, myelin permits rapid axonal conductance over long distances with small axonal volumes, a property that is essential for normal functioning of vertebrate nervous systems. The debilitating effects of diseases that affect myelin, such as Charcot Marie Tooth Syndrome and multiple sclerosis, demonstrate its importance. Myelin is produced by Schwann cells in the PNS and by oligodendrocytes in the CNS. Both cell types ensheathe axons, then wrap them with multiple layers of membrane that, following exclusion of cytoplasm and compaction, constitute the myelin sheathes. However, the molecular mechanisms that control the synthesis of myelin are poorly understood.

Schwann cells are the primary glial cells of the peripheral nervous system. Myelinating Schwann cells form a single myelin sheath around a single axon, whereas non-myelinating Schwann cells typically ensheathe several unmyelinated axons. Axons regulate the proliferation of Schwann cells, and in addition, they are thought to regulate their differentiation: presumptive myelinated axons signal Schwann cells into the myelinating lineage, whereas the axons lacking this signal remain associated with non-myelinating Schwann cells. Intracellular cAMP signaling is thought to play a central role in axonal control of both Schwann cell proliferation and differentiation, although the nature of the signal(s) that induce elevation of the levels of cyclic AMP (cAMP) in Schwann cells remain unknown. In cultured Schwann cells, many aspects of axon-induced Schwann cell proliferation and differentiation can be mimicked by activators of adenylyl cyclase, such as forskolin. Forskolin treatment decreases expression of genes that are associated with non-myelinating Schwann cells and immature Schwann cells, and increases expression of genes associated with myelinating Schwann cells, including the POU domain transcription factor Oct-6 and the zinc-finger transcription factor Krox-20. These data indicate that cAMP may be a second messenger of the axonal signal that promotes myelination, and that the change to the myelinating phenotype is mediated by changes in the expression of several transcription factors. Both Oct-6 and Krox-20 play essential roles in the development of myelinating Schwann cells (Bermingham et al., *Gene Develop* 10:1751 (1996)). However, the precise role played by cAMP signaling in Schwann cell myelination is not yet fully understood.

Oct-6 (also known as Tst-1 or SCIP) is a member of the POU domain family of transcription factors. These proteins are characterized by their possession of a bipartite DNA binding domain (the POU domain) that also provides binding sites for many proteins that interact with POU proteins. Oct-6 is expressed transiently during Schwann cell development (Monuki et al., *Neuron* 3:783 (1989)), specifically in promyelinating Schwann cells, which have formed a 1:1 relation with axons but have not yet formed a myelin sheath. Oct-6 represses expression of several myelin-related promoters in transient cotransfection assays, and on this basis, has been hypothesized to repress myelination. It is also expressed transiently in oligodendrocytes (Collarini et al., *Development* 116:193 (1992)). The phenotypes of mutations in Oct-6 indicate that it can control the timing of myelination. In the absence of Oct-6, Schwann cell differentiation is delayed, transiently arrested at the promyelinating stage (Bermingham et al., *Gene Develop* 10:1751 (1996) and Jaego, et al., *Science* 273:507 (1996)). CNS myelination appears normal, perhaps due to the presence in oligodendrocytes, but not Schwann cells, of two other members of the class III POU domain family, Brn-1 and Brn-2 (Schreiber et al., *J Biol Chem* 272:32286 (1997)). Transgenic mice that express a truncated form of Oct-6 in Schwann cells display precocious peripheral myelination (Weinstein et al., *Mol Cell Neurosci* 6:212 (1995)), and Oct-6 misexpression in oligodendrocytes causes precocious CNS myelination and hypomyelination (Jensen et al., *J Clin Invest* 101:1292 (1998)). Oct-6 has been hypothesized to activate genes required for Schwann cell differentiation, then to repress terminal differentiation.

The identification of target genes that are regulated by Oct-6 would enhance our understanding of its role in Schwann cell development. Recently, representational difference analysis (RDA; (Lisitsyn, *Trens Genet* 11:303 (1995)), a PCR-based technique that permits the isolation of DNA fragments that are present in one DNA sample but absent in another, was used to identify genes that are differentially expressed in sciatic nerve from Oct-6 homozygous mutant (−/−) and wild-type (+/+) mice. Six cDNA fragments were identified that correspond to genes that are activated by Oct-6; no repressed genes were identified, suggesting that Oct-6 functions as an activator in Schwann cells (Bermingham et al., manuscript in preparation). Of these genes, only one has been described previously in Schwann cells, and three are novel. The identities of two known putative target genes suggest cytoskeletal rearrangement or fatty acid transport as rate-limiting steps in myelination that are activated by Oct-6. One of the previously unknown genes named Tramdorin 1 (transmembrane domain rich protein). Tramdorin 1 has been assigned the human and mouse gene symbol tramd1.

RDA clone JBSN125 contained tramdorin1 sequences that were differentially expressed between Oct-6 (−/−) and wild-type (+/+) sciatic nerve, as well as a sequence whose expression was unaffected by the absence of Oct-6. A subclone of this, 125-10, contained only differentially expressed sequences and was used to isolate additional sequence for the tramdorin1 gene.

Mouse cDNAs that correspond to clone 125-10 were isolated by obtaining and sequencing three homologous EST clones. Mouse EST cDNA 1920302 defines a 2.5 kb cDNA (SEQ ID NO:13/GenBank Acession No.: AI 1780664). One of the EST clones appears to correspond to a partially spliced transcript. The full-length mouse cDNA contains a 1.4 kb open reading frame (FIGS. 2A-D) that encodes a protein of 52 kd. The mouse cDNA and the putative protein that it encodes do not match any genes in the GenBank non-redundant database, or the SwissProt database. Therefore, these cDNAs are derived from a novel gene. That is to say, there are no exact matches to the protein sequence.

The protein encoded by mouse cDNA 1920302 (SEQ ID NO:13) was predicted by several protein structure prediction programs to encode a transmembrane protein (see examples below). Regardless of the differing predictions about the number of transmembrane domains, or their topology, this protein appears to contain multiple transmembrane helices.

To determine the size of tramdorin mRNA(s) and to determine if tramdorin expression is restricted to sciatic nerve, a northern blot with RNAs from adult mouse sciatic nerve and other tissues was hybridized to a radiolabelled probe synthesized from tramdorin cDNA 1920302 (SEQ ID NO:13). Tramdorin1 expression is neither ubiquitous, nor restricted to sciatic nerve (see examples below).

It was of interest to determine whether the expression of tramd1 in sciatic nerve is modulated by nerve injury. A northern blot of RNA from sciatic nerves collected at various times following crush or transection injury was hybridized with a mouse tramd1 probe (see examples below). Tramd1 expression is downregulated by transection injury, and remains low. Following a crush injury, tramd1 is downregulated, but subsequently it is reexpressed as axons regenerate and are remyelinated. Therefore, the tramdorin1 gene encodes a myelin-related protein. Several genes that are required for normal myelination show this pattern of expression; these include Oct-6, P0, connexin32 and PMP-22 [Podsulo, *Regulation of myelin gene expression in the peripheral nervous system*. In Dyck, P. J. et al. (eds.), Peripheral Neuropathy, W.B. Saunders Co., Philadelphia, [1993] pp. 282-289; Scherer et al., *J Neurosci* 14:1930 (1994); Sohl et al., *Eur J Cell biol* 69:267 (1996)]. This result suggests that tramd1 may play an important role in the timely formation of peripheral myelin. Thus, an important function of Oct-6 in myelination may be activating the expression of tramdorin 1, a gene that encodes a novel transmembrane domain protein. Additionally, the expression of tramd1 following nerve injury indicates that it will be useful as a marker of myelinating Schwann cells. Following crush injuries, Schwann cells distal to the injury downregulate expression of myelin-related genes such as P0, and express markers of immature Schwann cells, such as p75 nerve growth factor [Poduslo, "Regulation of myelin gene expression in the peripheral nervous system." In Dyck, P. J. et al. (eds), Peripheral Neuropathy, W.B. Saunders Co., Philadelphia, pp. 282-289 (1993)]. As axons regenerate, they are remyelinated, with concomitant re-expression of myelin-related genes. Tramdorin1 shows this pattern of expression. Therefore the present invention contemplates using tramdorin 1 to augment current markers of myelinating Schwann cells.

Remyelination of axons in the CNS by Schwann cells has been explored extensively as a possible treatment for demyelinating diseases such as multiple sclerosis, and as a treatment for nerve injury. MS affects 1/1000 Americans, and in people of northern European descent, the frequency is 1/800 [Lynch et al., *Dis Mon* 42:1 (1996)]; it represents a significant public health problem in the United States and Europe. An understanding of the genes that regulate myelination by Schwann cells is needed for optimizing their use in remyelination in the CNS. While it is not necessary to understand the underlying mechanisms to practice the invention (and the invention is not limited to any particular mechanism), it is believed that the tramdorin 1 gene may play a crucial role in regulating myelination for the following reasons: First, it is a putative target gene for Oct-6, a transcription factor that is essential for timely peripheral myelination [Bermingham et al., *Gene Develop* 10:1751 (1996); Jaegle et al., *Science* 273:507 (1996)]. Second, its expression following nerve injury indicates that it encodes a myelin-related protein. Screens using tramdorin, and/or its putative ligands, will provide avenues for the development of therapeutic agents for the treatment of the effects of demyelination or nerve injury, both in the peripheral and central nervous systems. The ability to identify molecules that promote myelination will significantly enhance the prospects for successfully using Schwann cells, and perhaps oligodendrocytes and olfactory ensheathing cells as well, to mitigate the damage caused by MS and other demyelinating diseases. A significant use of tramdorin 1 will be in identifying such molecules (see section IV, "Functional Characterization of Tramdorins").

The mouse chromosomal location of Tramd1 was determined by interspecific backcross analysis using progeny derived from matings of [(C57BL/6J×*Mus spretus*)F$_1$× C57BL/6J] mice (see examples below). The mapping results indicated that Tramd1 is located in the proximal region of mouse chromosome 11 linked to Il13 and Hand1. The most likely gene order is: centromere-Il13-1/142-Tramd1-6/179-Hand1. The recombination frequencies (expressed as genetic distances in centiMorgans (cM)+the standard error) are-Il13-0.7+/−0.7-Tramd1-3.4+/− 3.4-1.4-Hand1. The proximal region of mouse chromosome 11 is syntenic with human chromosome 5q31-33. An autosomal recessive Charcot-Marie-Tooth Syndrome demyelinating neuropathy has been mapped to this region [Guilbot et al., *Ann NY Acad Sci* 883:56 (1999a); Guilbot et al., *Eur J Hum Genet* 7:849 (1999b); LeGuern et al., *Hum Mol Genet* 5:1685 (1996)], suggesting that tramdorin1 could be a candidate peripheral neuropathy disease gene.

II. Identification of Tramdorin Homologs in Rat and Other Species

A. Rat

A Rat cDNA that corresponds to mouse clone 125-10 was isolated by 5' and 3' RACE (rapid isolation of cDNA ends; [Frohman, *Methods Enzymol* 218:340 (1993); Frohman, *PCR Methods Appl* 4:S40 (1994)]). The 5' and 3' rat RACE fragments combined define a 2.5 kb (SEQ ID NO:55) cDNA. The full-length rat cDNA (SEQ ID NO:6) contains a 1.4 kb open reading frame (FIGS. 2A-D) that encodes a protein of 52 kd (SEQ ID NO:22). The rat cDNA and the putative protein that it encodes (FIGS. 2 and 15) does not match any genes in the GenBank non-redundant database, or the SwissProt database. Therefore, this cDNA is derived from a novel gene.

A Northern blot using rat tissue did not show hybridization to lung and thymus (data not shown), suggesting that there may be variation in tramdorin 1 expression among species, or cross-hybridization to related sequences in the mouse Northern blots.

B. Human

Figure 16A:
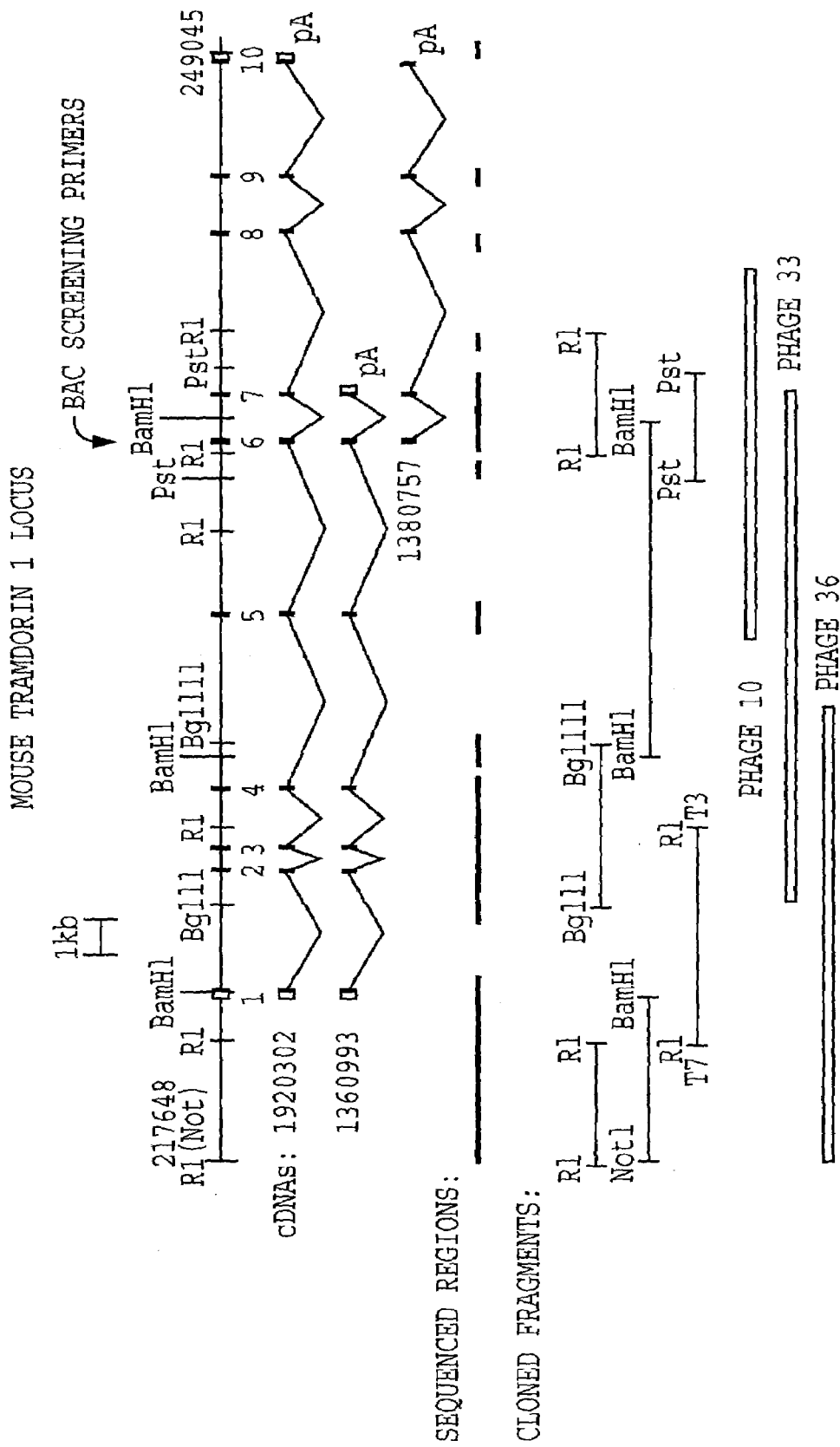
FIGS. 16A-C depict the organization of mouse tramdorin loci. Exons are denoted as boxes; filled boxes denote coding regions. Coordinates denote the location of the sequences on Celera mouse genome scaffold sequence GA_xK02T2QP88:1-500000. 16A Mouse tramd1. A partial restriction map is shown at the top of the figure. Shown below the map are three tramd1 EST cDNAs that define tramd1 exons. Genomic regions that were sequenced prior to the availability of the Celera mouse genome sequence are show as thick lines below the cDNAs, and below them, select subcloned fragments are shown. 16B Mouse tramd2. Two mouse tramdorin2 RACE cDNA clones are shown. 16C Mouse tramd3. A partial restriction map is shown at the top of the figure. Exons 2-8 were defined by homology to mouse tramd1 or human tramd3. Three mouse tramdorin3 cDNA clones are shown; two are RACE clones, and one was amplified with tramd3-specific primers. Regions that were sequenced prior to the availability of the Celera mouse genome sequence are shown below the exons; these sequences were obtained from the ends of the cloned fragments shown at the bottom of the figure, or from the Ensembl mouse genome sequence database. Note that tramdorin3 is transcribed in the opposite direction from tramdorin1 and tramdorin2.
Figure 16B:
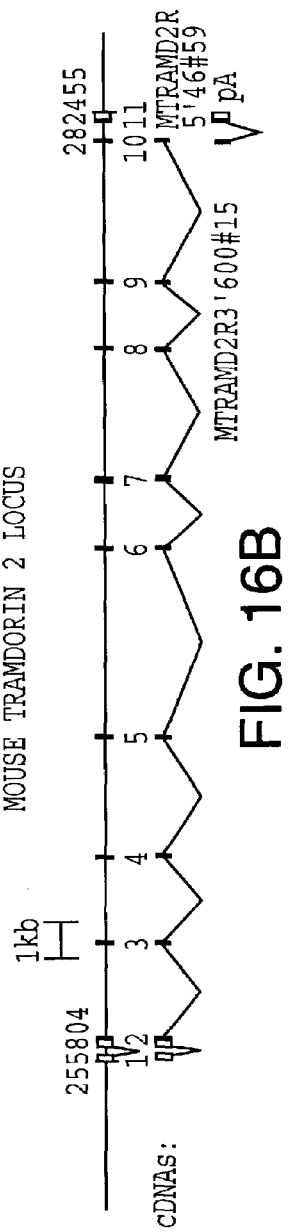
Figure 16C:
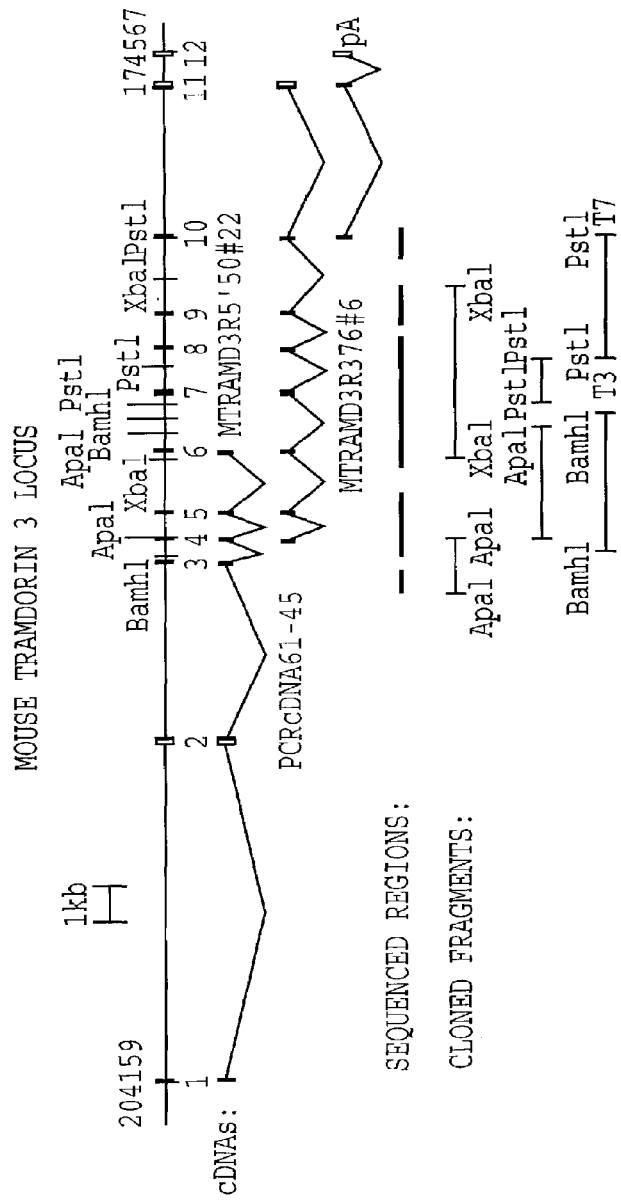

As noted above, the proximal region of mouse chromosome 11 is syntenic with human chromosome 5q31-33, suggesting that the human homolog of tramd1 will map to 5q31-33 as well. An autosomal recessive Charcot-Marie-Tooth Syndrome demyelinating neuropathy has been mapped to this region, suggesting that tramdorin 1 could be a candidate peripheral neuropathy disease gene;

As a first step toward determining if tramdorin 1 mutations are associated with human peripheral neuropathy, the human tramdorin gene was studied. Six human EST cDNAs that possess homology to mouse tramdorin1, I.M.A.G.E numbers 3184556 (BE501426), 1738130 (AI140615), 1837427 (AI208756), 1388139 (AA843982), and 2549054 (AI953890), as well as EST cDNA DKFZp434G1123 from the Deutsches Ressourcezentrum für Genomforschung GmbH (RZPD) were obtained and sequenced in their entirety. The sequences were aligned on human genomic DNA from the International Human Genome Sequencing Consortium (IHGSC) and Celera databases. These cDNAs showed greatest homology to four discrete locations within 250 kb of chromosome 5q sequence (FIG. 7), confirming the mapping of tramdorin in mouse, but in addition, suggesting the existence of multiple tramdorin genes (see examples below). These genes have been assigned the names tramd1 (SEQ ID NO:9), tramd2 (SEQ ID NO:10), tramd3 (SEQ ID NO:11), and tramdL (SEQ ID NO:12). The predicted cDNA and encoded amino acid sequences of human tramd1 (cDNA: SEQ ID NO:3; corresponding amino acid sequence: SEQ ID NO:19), tramd2 (cDNA: SEQ ID NO:4; corresponding amino acid sequence: SEQ ID NO: 20) and tramd3 (cDNA: SEQ ID NO:5; corresponding amino acid sequence: SEQ ID NO: 21) are shown in FIGS. 10, 11, and 21, respectively. The amino acid sequence of human tramd3 (SEQ ID NO:21) is also depicted in FIG. 17 (aligned with mouse tramd3), and the amino acid sequences of human tramd 1 (SEQ ID NO:19), tramd 2 (SEQ ID NO:20) and tramd 3 (SEQ ID NO:21) are also depicted in FIGS. 14, 15, 16 (tramd1), FIGS. 13A-B (tramd 2) and FIGS. 13A-B, 16, 20 (tramd 3).

A fourth tramdorin-related sequence, tramdL, is defined by the EST cDNA 1388139 (SEQ ID NO:23) (FIGS. 8D and 12). tramdL contains only sequences that are homologous to exon 10 of tramdorin1. This cDNA is derived from a parathyroid adenoma, and is unusual in that its 5' end consists of sequences derived from a member of the STE20 family of kinases, STK4/Mst-1/Krs-2 (FIGS. 11A-B; Creasy et al., *J Biol Chem* 270:21695 (1995); Taylor et al., *PNAS USA* 93:10099 (1996)), located on human chromosome 20. The STK4/Mst-1/Krs-2 cDNA fragment is fused to 3' sequences of tramdL FIG. 11C, located on chromosome 5. This observation raises the possibility that tramdL resides near a parathyroid tumor translocation breakpoint, between chromosomes 20 and 5, that results in expression of a STK4/Mst-1/Krs-2-tramdorinL fusion protein. Such a fusion protein may be relevant in the etiology of parathyroid tumors, such as parathyroid adenomas, and several applications involving the use of this fusion in the evaluation of parathyroid tumors, including but not limited to parathyroid adenomas, and in the development of an animal model of parathyroid tumors, including but not limited to parathyroid adenomas, are contemplated (see Section V, Tramdorins and Parathyroid Tumors and Examples below).

To determine the tissues in which the various tramdorin genes are expressed in humans, a northern blot of RNA derived from 12 human tissues was sequentially hybridized to radiolabelled cDNA probes that correspond to human tramd1, 2, 3 and tramd1 that were constructed as follows:

htramd1 probe: Probe consists of 355 bp EcoRI-PvuII fragment of EST cDNA 3184556. The Eco RI site resides in the vector that contains the cDNA; the probe contains human tramd1 exons 7 and 8, and part of the intron between exons 8 and 9, ending at the PvuII site at position 248018 in SEQ ID NO:26.

htramd2 probe: Probe consists of 440 bp EcoRI-NcoI fragment of EST cDNA 1837427. The Eco RI site resides in the vector that contains the cDNA; the probe contains sequences from position 1209 to the Nco site at position 1636 in FIGS. 10A-B, and contains part of human tramd2 exon 9, exon 10, and part of exon 11.

htramd3 probe: Probe consists of 850 bp StuI-KpnI fragment of EST cDNA 2549054, consisting of the sequences between the StuI site at position 232 and the Kpn site at position 1080 on FIG. 18A and FIG. 18B.

htramdL probe: Probe consists of 340 bp MscI-DraI fragment of EST cDNA 1388139, consisting of the sequences between the MscI site 7 bp 3' to the 3' splice site of tramdL and the DraI site at the 5' end of the polyA tail of this cDNA, which is marked by an asterisk in FIG. 11C.

Each probe produced a distinct hybridization result (see example below). Translation of the known putative coding exons for human tramdorins 1, 2, and 3 indicate that these proteins are highly conserved (see example below).

C. Tramdorins in Other Organisms

The most closely related sequences to tramdorins are putative proteins that have been derived from the *Drosophila, Caenorhabditis elegans* and *Saccaromyces cerevisiae* genome sequences (see example below). Mouse tramd1 protein is 39% identical to *Drosophila* protein CG13384, and 32% identical to the T27A1.5 protein from *C. elegans*. The functions of these proteins in invertebrates may be related to tramdorin function in vertebrates. If so, tramdorins would be required for a function that is conserved by evolution.

Seven novel yeast amino acid transporter genes, Avt1-7, were identified by virtue of their homology to vesicular GABA transporter (VGAT) sequences (Russnak et al., *J Biol Chem* 276:23849 (2001)). VGAT/VIAAT/Unc-47 proteins are the known proteins that are most related to tramdorin/LYAAT proteins FIGS. 15A-B. A CLUSTAL W comparison of human and mouse tramd1, human tramd2, human tramd3 and AVT1-4 and AVT7 proteins demonstrates that the tramdorins are most closely related to AVT3 and AVT4 (data not shown). Most of the AVT proteins, including AVT3 and AVT4, were localized to vacuoles, a yeast organelle that closely resembles mammalian lysosomes, consistent with the localization of tramd3/LYAAT1 to lysosomes (Sagne et al, *PNAS USA* 98:7206 (2001)). AVT3, 4, and 6 appear to be involved in amino acid export from vacuoles, suggesting that tramdorins could perform a similar function in lysosomes. However, the observation that not all AVT proteins appear to be localized exclusively in vacuoles suggests that other mammalian homologs of these proteins may exist in different subcellular locations.

D. Structure of Tramd Proteins

While an understanding of the precise structure of tramdorins is not necessary to the practice of the present invention, a number of considerations suggest that tramd proteins consist of II transmembrane domains, with the N-terminus facing the cytoplasm (see example below). The vertebrate proteins to which the tramdorins are most closely related are vesicular γ-aminobutyric acid (GABA) transporters (VGATs; see example below; [McIntire et al., *Nature* 389: 870 (1997); Sagne et al., *FEBS Lett* 417:177 (1997)]).

III. Organization of the Tramdorin Locus in Human and Mouse

A. Human

As noted above, human EST cDNAs that possess homology to mouse tramdorin 1 were aligned on human genomic DNA from the International Human Genome Sequencing Consortium (IHGSC) *Homo sapiens* chromosome 5 working draft sequence segment NT_006951.4 and Celera databases [Lander et al., *Nature* 409:860 (2001); Venter et al., *Science* 291:1304 (2001)]. These cDNAs showed greatest homology to four discrete locations within 250 kb of chromosome 5q sequence (FIG. 7), confirming the mapping of tramdorin in mouse, but in addition, suggesting the existence of multiple tramdorin genes. These genes have been assigned the names tramd1, tramd2, tramd3, and tramdL. The human tramd1 (SEQ ID NO:9) gene has greatest homology to the original mouse tramd1 (SEQ ID NO:7) gene, and is flanked on its 3' end by tramd2 (SEQ ID NO:10), and on its 5' end by tramd3 (SEQ ID NO:11), which is transcribed in the opposite orientation to tramd1 and tramd2. Nested between tramd1 and tramd3 resides a tramdorin gene fragment, tramdL (SEQ ID NO:12), in the same orientation as tramd1 and tramd2. It consists only of 3' tramdorin sequences, and is defined by a single EST cDNA, 1388139 (SEQ ID NO:23). All four putative genes are found on both the Celera and IHGSC sequences. FIGS. 8A-D presents the organization of the human tramdorin loci (see Example below for details of the organization). The cDNAs in FIGS. 8A-D are aligned with Celera human chromosome 5 scaffold sequence GA x2HTBL3TT27:2500000-3000000, except where noted in the figure. The genomic sequence of 250 kb of sequence from the entire tramdorin region (nucleotides 50001-300000 of the IHGSC *Homo Sapiens* chromosome 5 working draft sequence segment NT_006951.4) is presented in SEQ ID NO:26. Known tramdorin exons are shown in bold type, and indicated to the right of the sequence. Initiation ATG and stop codons, and putative polyadenylation signal sites are shown in bold italic. Note that tramd3 is in the opposite orientation relative to the other tramd genes, and is shown in the antisense orientation.

Figure 9A:
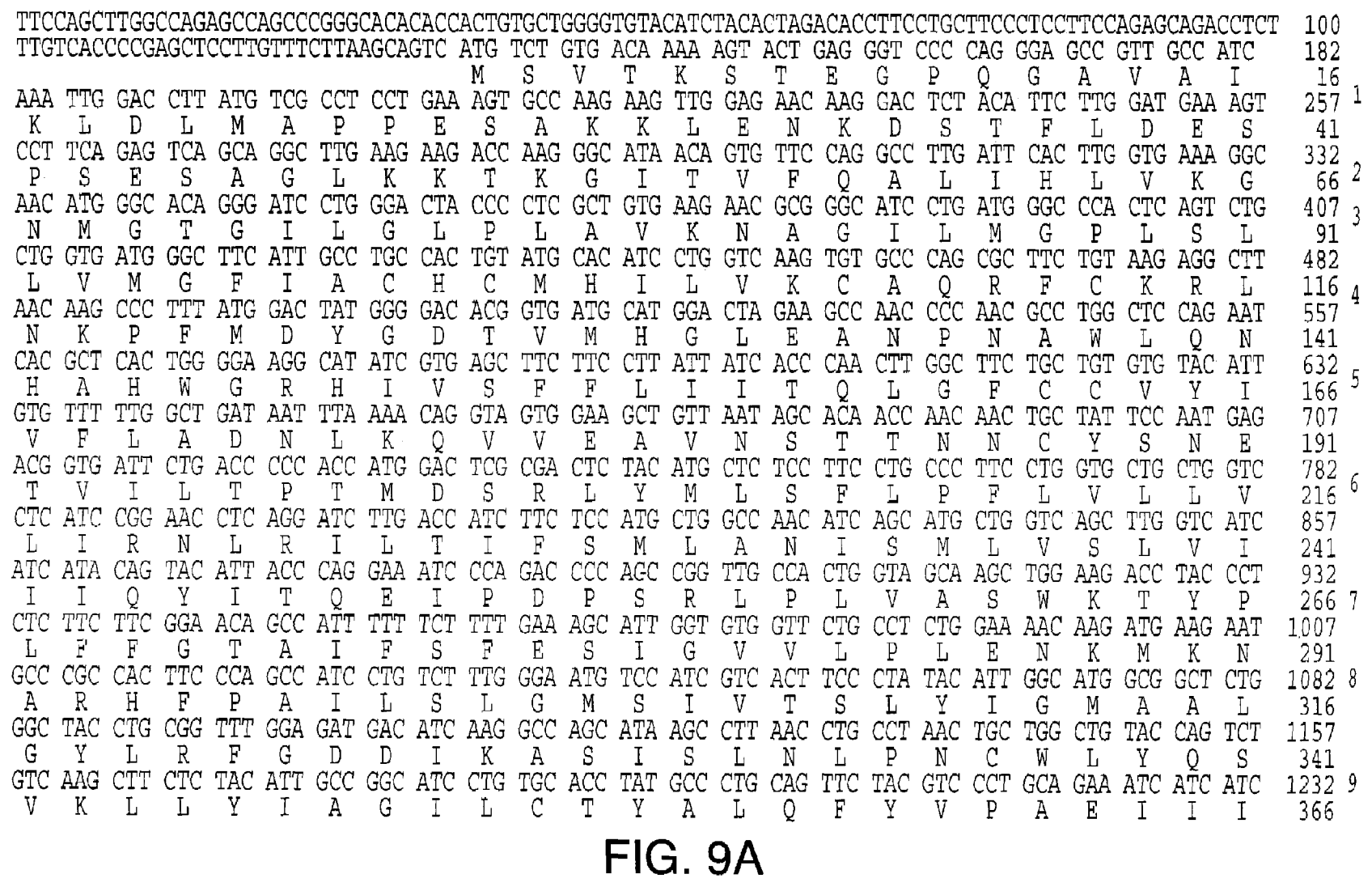
Figure 9B:
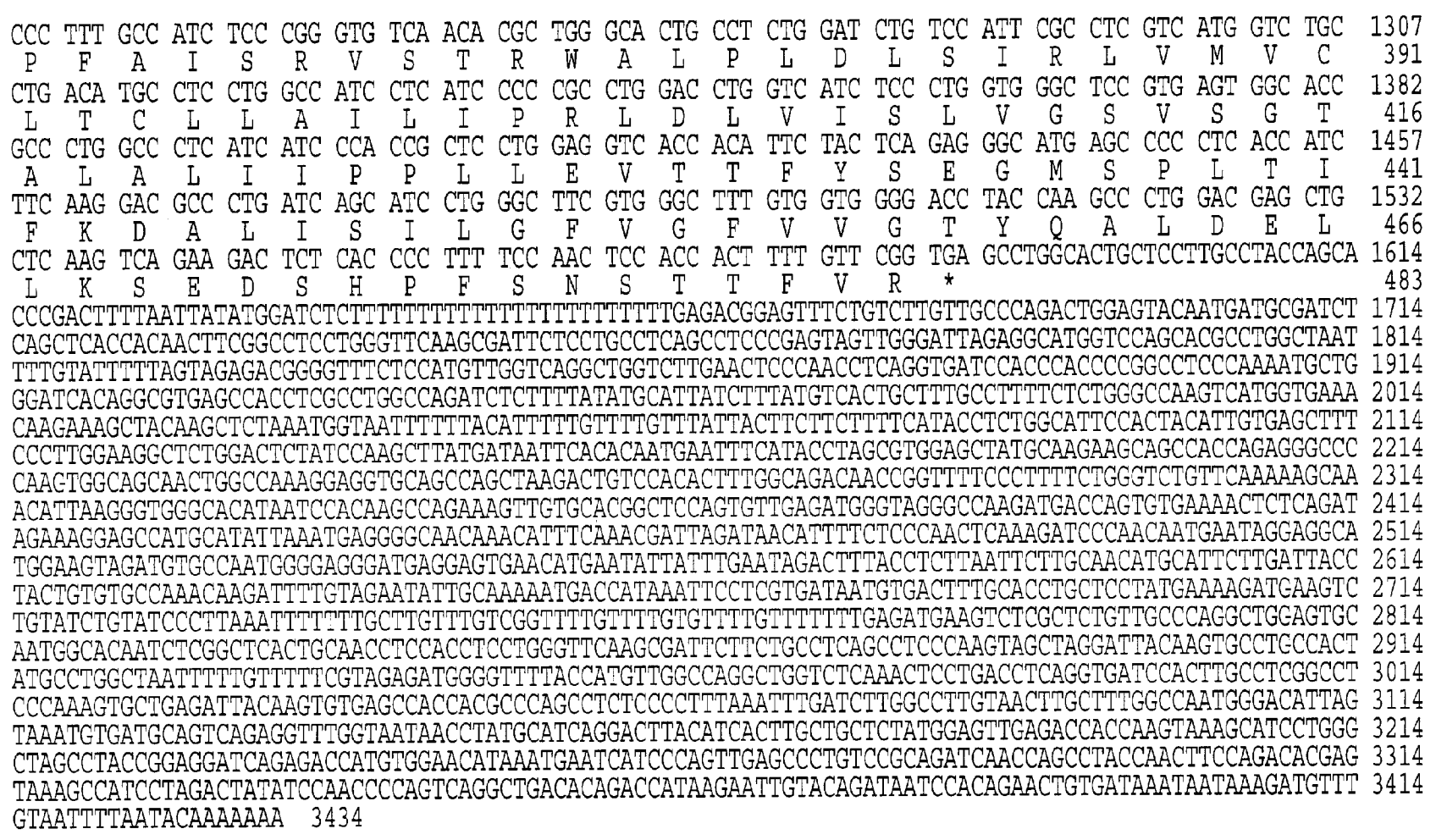
Figure 10A:
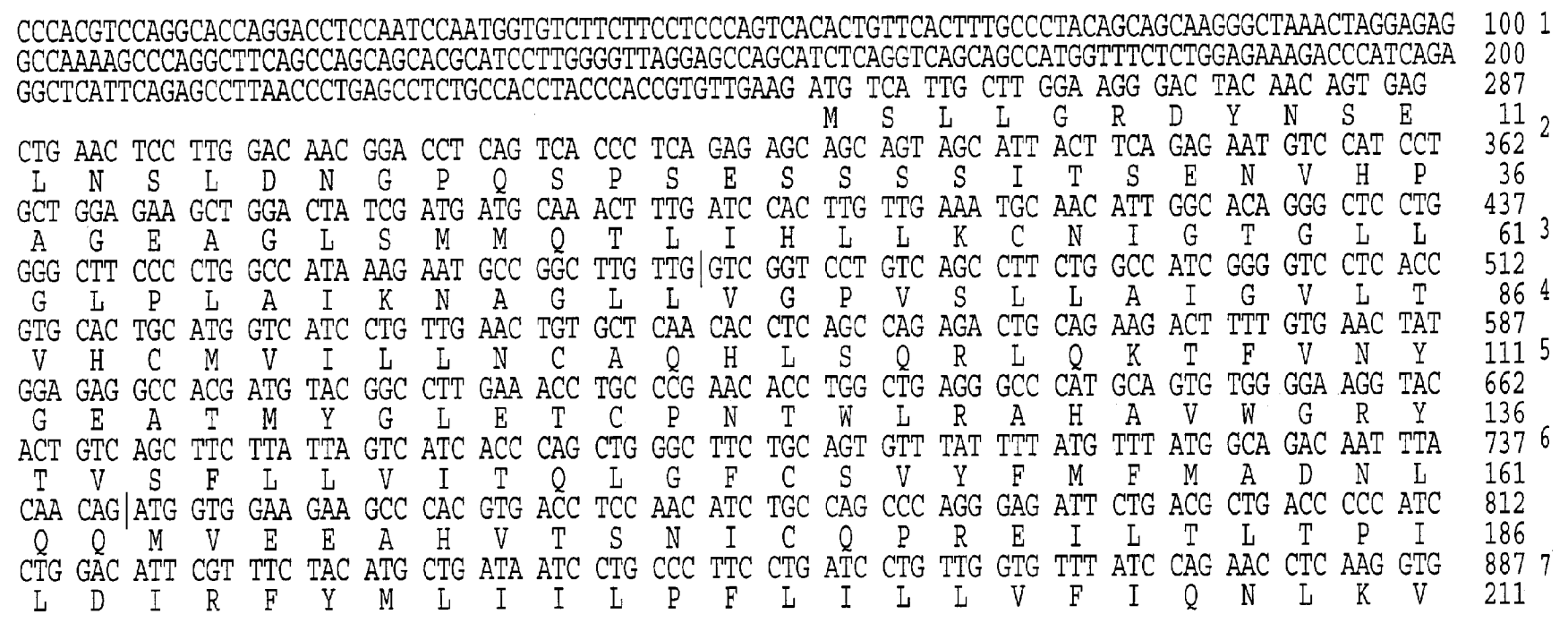
Figure 10B:
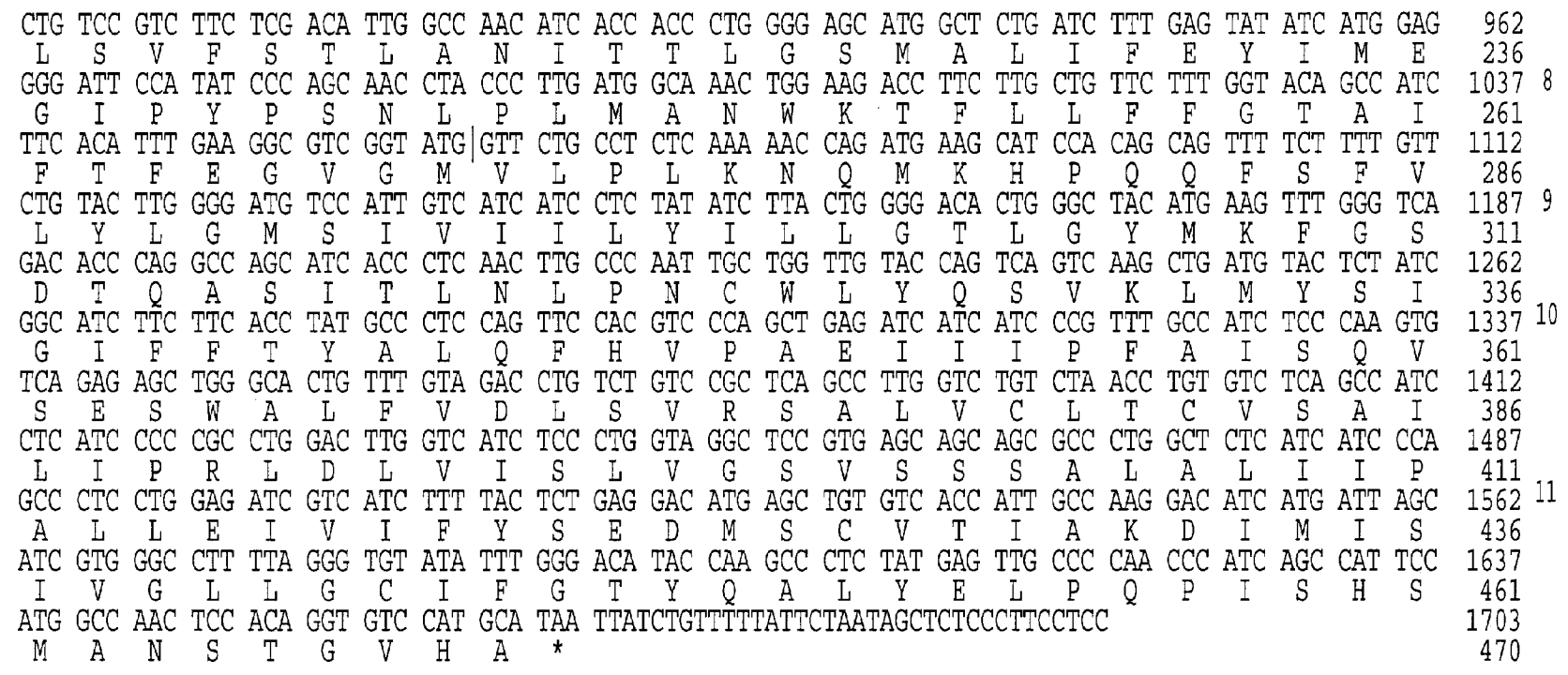
Figure 18B:
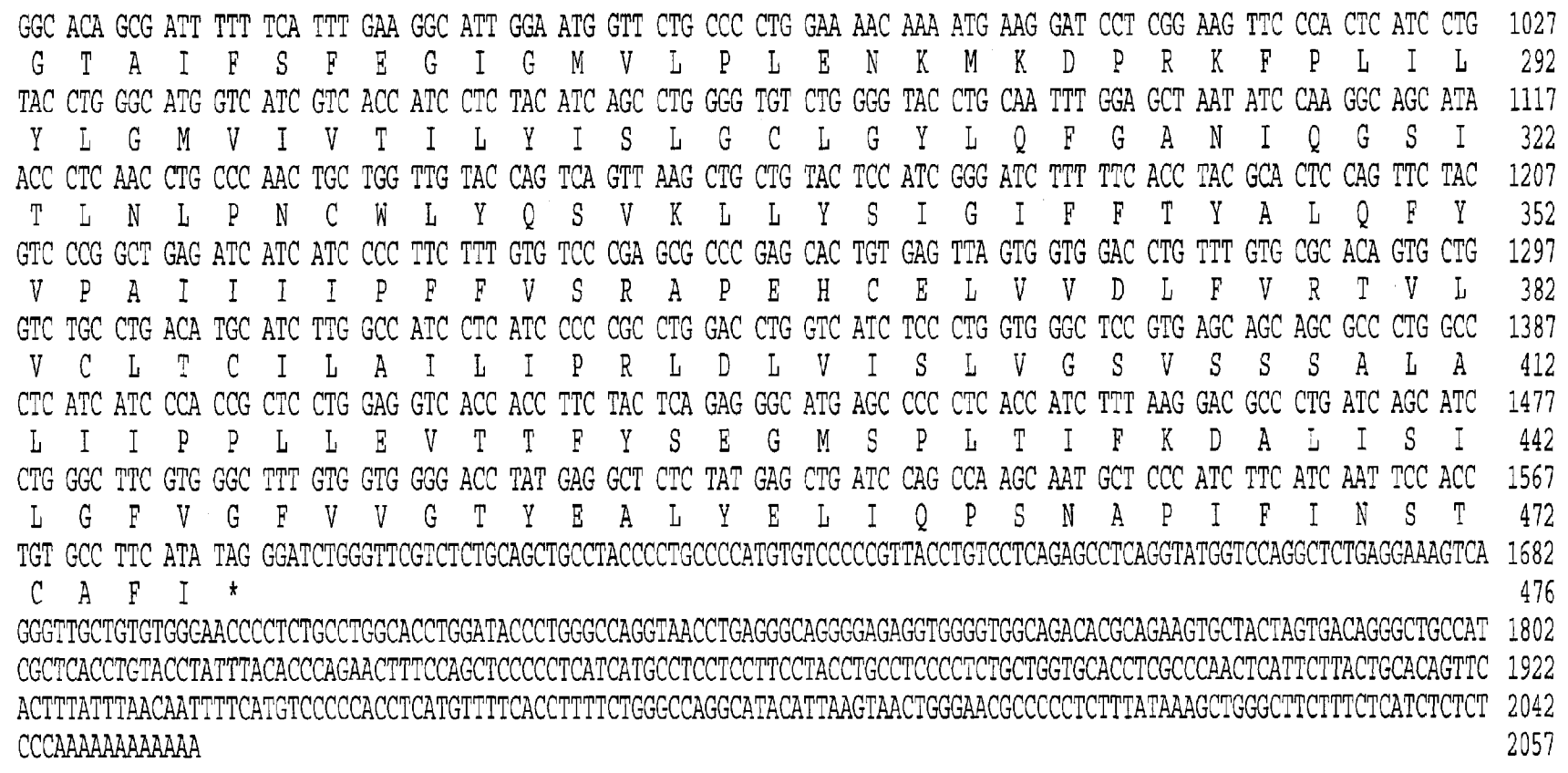

Details of the structure of the individual tramdorin genes are presented in the example below. Briefly, the structure of human tramdorin 1 (SEQ ID NO:9) was determined by identifying regions of homology between mouse and human tramdorins, and by cDNA sequences. FIG. 9A and FIG. 9B depicts the putative human tramd 1 cDNA (SEQ ID NO:3) and encoded protein (SEQ ID NO:19). Human tramdorin 2 (SEQ ID NO:4) exons are defined by a single EST cDNA and by homology with tramdorins 1 (SEQ ID NO:3) and 3 (SEQ ID NO:5), and mouse tramd2 (SEQ ID NO:1) cDNA. FIGS. 10A-B depicts the putative cDNA (SEQ ID NO:3) and encoded protein (SEQ ID NO:20) for human tramd 2. The sequences of four alternatively spliced tramdorin 3 EST cDNAs were used to infer the structure of the tramdorin 3 gene. FIG. 18A and FIG. 18B depict a composite human tramd3 cDNA (SEQ ID NO:5) and corresponding amino acid sequence (SEQ ID NO:21). A fourth tramdorin-related sequence, tramdL (SEQ ID NO:12), is defined by an EST cDNA which is derived from a parathyroid adenoma. TramdL contains sequences which are homologous to exon 10 of tramdorin 1. The 5' end of this EST cDNA consists of sequences derived from a member of the STE20 family of kinases, STK4/Mst-1/Krs-2 [Creasy et al., *J Biol Chem* 270:21695 (1995); Taylor et al., *PNAS USA* 93:10099 (1996)], located on chromosome 20. The STK4/Mst-1/Krs-2 cDNA fragment is fused to 3' sequences of tramdL, located on chromosome 5. This observation raises the possibility that tramdL resides near a parathyroid tumor translocation breakpoint, between chromosomes 20 and 5, that results in expression of a STK4/Mst-1/Krs-2-tramdorinL fusion protein (see Section V, Tramdorins and Parathyroid Tumors below).

B. Mouse

The organization of the mouse tramd1 gene (SEQ ID NO:7) was studied to understand better the origin of the alternatively spliced tramdorin cDNAs, and as a preliminary step toward generating mice that lack tramd1 function. A 129 mouse genomic library in bacteriophage λ was screened with a probe consisting of a 720 bp XhoI-NcoI fragment from cDNA 1920302 (SEQ ID NO:13) that contains sequence from exons 1-6. Three phage were isolated FIG. 16A. In addition, a bacterial artificial chromosome (BAC) library (Research Genetics) was screened using the polymerase chain reaction (PCR) using primers that amplify 169 bp of exon 6 (see example below). A single tramdorin-containing BAC was isolated. Subclones from the BAC and from the lambda phage were sequenced to determine the structure of the 5' end of the tramdorin gene. The genomic sequence 3' to exon 7 corresponds to sequence in EST cDNA 1363993 (SEQ ID NO:43), indicating that this cDNA is partially spliced. Exons 8, 9, and 10 are defined by sequences from the Ensembl database. Mouse tramdorin 1 genomic sequences are presented in (SEQ ID NO:7).

To determine if the BAC contained genomic sequences for additional mouse tramdorin genes, plasmids that contained shotgun-cloned BAC DNA were arrayed on dot blots. Sequence analysis of clones that hybridized to radiolabelled tramd1 cDNA probes revealed that in addition to tramd1 sequences, the BAC also contained tramdorin 3 sequences FIG. 16B. Mouse tramdorin 3 genomic sequences (SEQ ID NO:8), and a comparison between mouse (SEQ ID NO:18) and human tramdorin 3 (SEQ ID NO:21) proteins is presented in FIG. 17. Because BACs typically contain approximately 100 kb of DNA, the presence of tramd1 and tramd3 sequences in the same BAC suggests that these genes may reside more closely to one another in mice than they do in humans.

Composite mouse tramd3 cDNA (SEQ ID NO:3) is presented in FIGS. 20A-B. As described in the example below, mouse tramdorin 3 cDNAs were obtained by 5' and 3' RACE amplification from Swiss Webster mouse brain RACE-ready cDNA (Ambion), and by amplification of the same mouse brain cDNA using primers, as detailed in the example below. The cDNA depicted in FIGS. 20A-B contains the entire tramd3 protein coding region, but does not contain the entire 3' untranslated region.

Figure 19A:
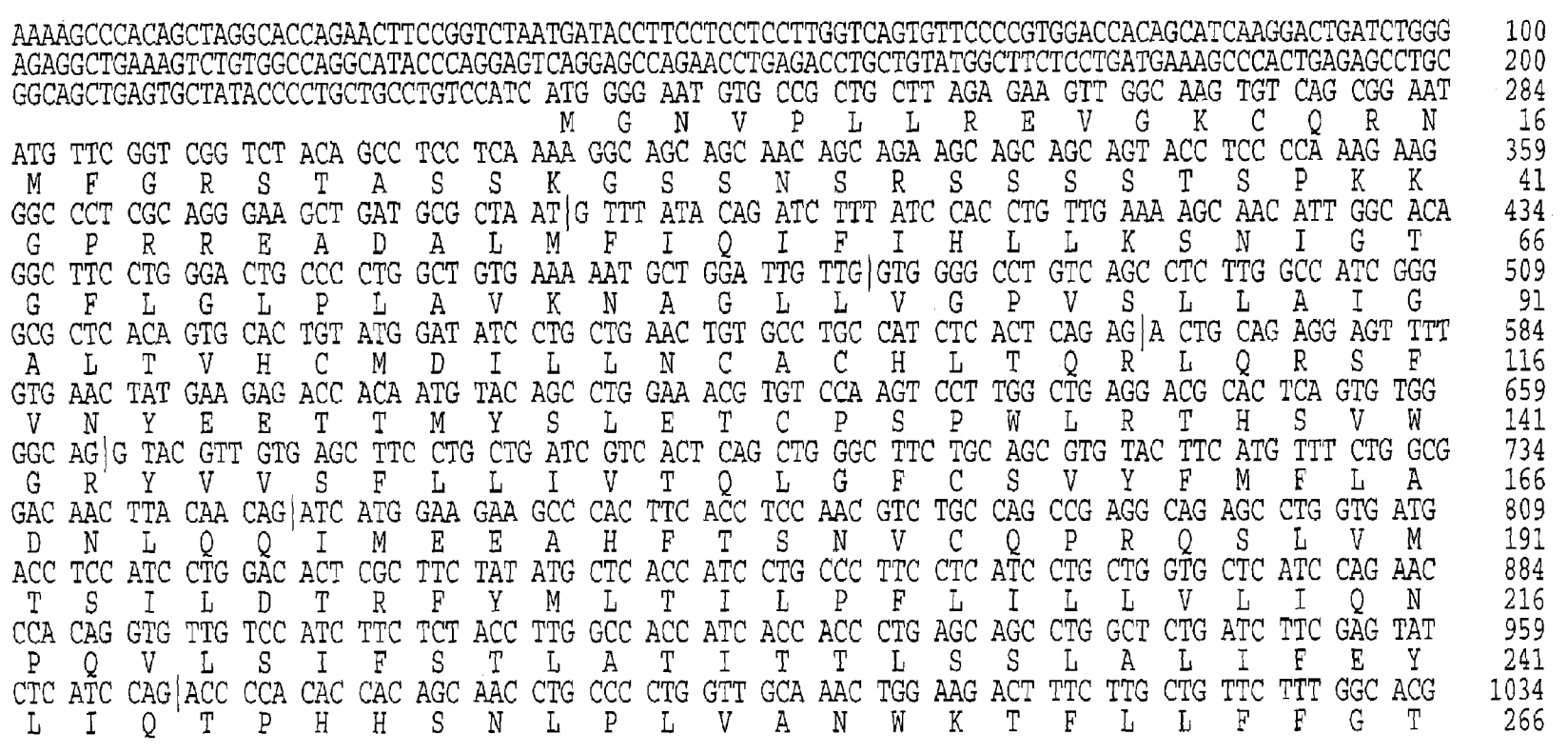
Figure 19B:
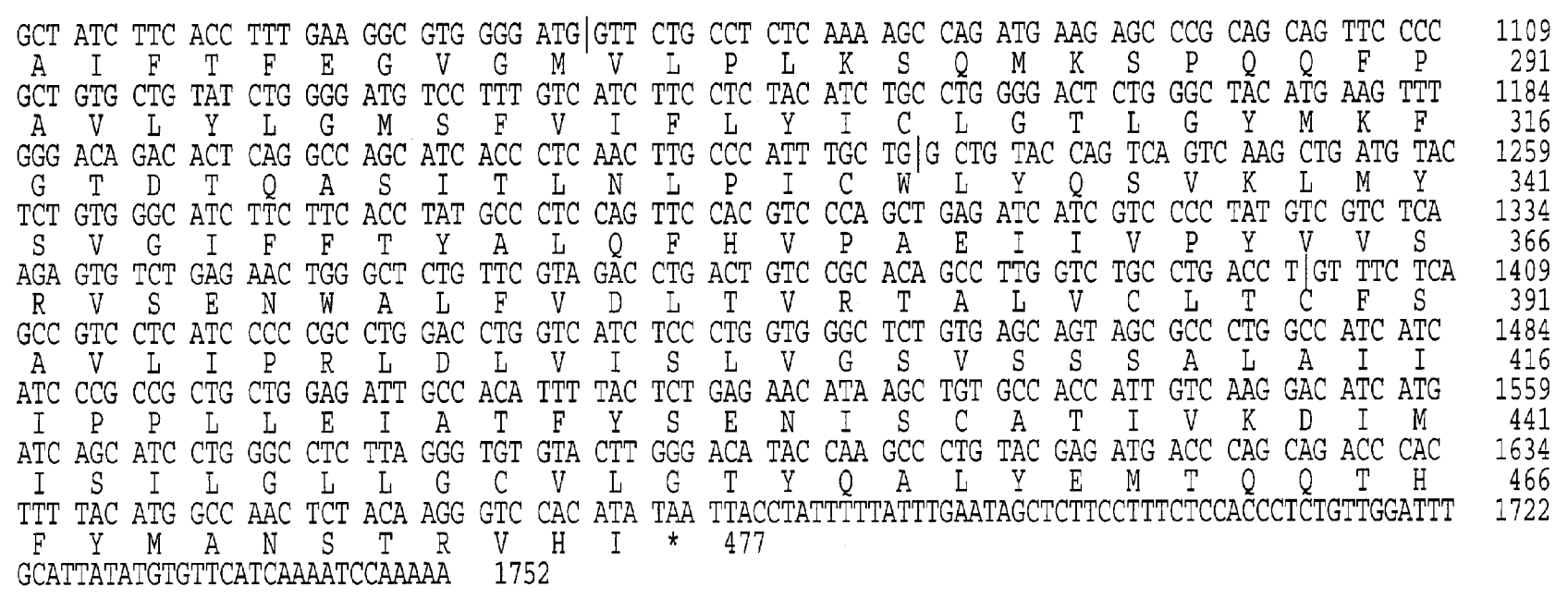

Composite mouse tramdorin 2 cDNA (SEQ ID NO:1) is presented in FIG. 19A and FIG. 19B. As described in the example below, 5' and 3' RLM-RACE (Maruyama et al., Gene 138:171 (1994); Schaefer, Anal Biochem 227:255 (1995)) were used to isolate mouse tramdorin 2 cDNAs from a mouse testicle cDNA library (Ambion). The absence of a consensus polyadenylation site and the observation that the poly(A) sequences at the 3' end are found in genomic DNA indicate that the 3' RACE cDNA is not full-length.

IV. Functional Characterization of Tramdorins

A. Identification of Tramdorin Ligands

The signal(s) from axons that initiate myelination are unknown. Several molecules that stimulate Schwann cell myelination have been identified. Insulin-like growth factor promotes Schwann cell proliferation in conjunction with other growth factors, but in their absence, it promotes Schwann cell expression of P0 and myelination (Russell et al., J Neuropathol Exp Neurol 59:575 (2000); Stewart et al., Eur J Neurosci 8:553 (1996)). Progesterone and glucocorticoids have been shown to enhance the rate of myelination. However, none of these molecules has been shown to be sufficient for triggering myelination by Schwann cells. Studies on regenerating nerves following injury indicate that axonal contact is required for Schwann cells to myelinate (reviewed in Scherer et al., Axon-Schwann cell interactions in peripheral nerve regeneration. In Jessen, K. R. and Richardson, W. D. (eds.), Glial Cell Development, Bios Scientific Publishers, Oxford, [1996] pp. 165-196). However, Schwann cells repressed expression of p75NGFR, and expressed Oct-6 and P0 in response to neurons that were separated by a permeable membrane, suggesting that at least one important axonal signal for the differentiation of Schwann cells to a myelinating phenotype is a diffusible molecule (Bolin et al., J Cell Biol 123:237 (1993)). In theory, axons can control the thickness of myelin sheathes that surround them by emanating a single myelinogenic signal which both triggers myelination, and instructs it to continue as long as the signal is present; cessation of the signal terminates myelination (Fraher et al., J Anat 193:195 (1998)). Based on its homology to the vesicular GABA transporter, tramdorin protein may function as a transporter of small molecules. If tramdorin is required for proper myelination, it may transduce a signal from axons that promotes myelination, and therefore may be a crucial reagent in the identification of the myelinogenic signal itself. Alternatively, tramd1 could interact directly with molecules that are expressed on the surface of axons, or it could act as a cofactor for other Schwann cell signaling molecule(s). Tramd2 and tramd3 genes may function similarly in the differentiation of other cell types as well.

One of skill in the art will understand that there are many methods that can be used to screen for tramdorin ligands. The present invention contemplates that any such assay may be used. By way of non-limiting example, one such assay involves identification of tramdorin ligands by the differential import of radiolabelled candidate ligands following transient expression of tramdorins in cultured cells. COS-7 cells will be transiently transfected with pcDNA3.1 plasmids (Invitrogen) with or without tramdorin sequences. Following exposure to [$^3$H] amino acids, the differential uptake of the radiolabelled amino acids will be measured by scintillation counting of cell extracts, as performed previously for rat LYAAT-1 [Sagne et al., PNAS USA 98:7206 (2001)]. Briefly, tramdorin cDNA sequences will be cloned into pcDNA3.1 plasmids, which will be introduced into COS-7 cells with Lipofectin (Life Technologies, Grand Island, N.Y.). Transport assays will be carried out 36-48 hours after the beginning of transfection. Following exposure to [$^3$H] amino acids, cells are lysed in 0.1 N NaOH, and the radioactivity will be measured by scintillation counting in Aquasol (Packard) (see Example below).

As rat LYAAT-1 is a tramdorin 3 homolog, and Sagne et al. (supra) used the COS-7 transfection and transport assay to successfully identify the ligand for LYAAT-1, there is compelling evidence that such an assay will be successful at identifying the ligands of human and mouse tramdorins, as well as rat tramdorin 1.

Another assay contemplated for the identification of tramdorin ligands is the expression of tramdorin in Xenopus oocytes. Xenopus oocytes have been used extensively to characterize transport proteins (reviewed in (Miller et al., Biochim Biophys Acta 1465:343 (2000); Theodoulou et al., Methods Mol Biol 49:317 (1995); Wagner et al., Cell Physiol Biochem 10:1 (2000)). In the Xenopus oocyte expression system, oocytes removed from ovaries of adult Xenopus are arrested at the first meiotic prophase. Because each oocyte is fairly large and has a large nucleus, it is technically easy to inject foreign DNA into the oocyte nucleus or mRNA injected into the cytoplasm. In this case, a synthetic tramdorin message is made that possesses a 5' cap and a poly(A)+ tail, and in which the tramdorin coding sequences are flanked by *Xenopus* β-globin 5' and 3' untranslated regions. The synthetic message is microinjected into the cytoplasm, followed several days later by characterization of the expressed protein. Alternatively, tramdorin genes can be microinjected directly into the nuclei of *Xenopus* oocytes, following cloning into the expression plasmid pMT3 (Swick et al., *PNAS USA* 89:1812 (1992)). Tramdorin proteins will be characterized by measurement of the rate and extent of uptake of radiolabelled candidate ligands relative to mock injected oocytes, as described above in the COS-7 assay. The large size of the oocytes makes it relatively easy to insert electrodes into the oocytes in order to measure the electrophysiological responses (i.e. patch clamp electrophysiology). The two-electrode voltage clamp can be used to measure transport activity in the presence of ligand(s).

B. Effect of Overexpression of Tramdorin Proteins on Myelination by Schwann Cells Primary Schwann cells will form myelin when co cultured with neurons; such co cultures can form the basis for an assay of tramdorin function during myelination. Achieving myelination by primary Schwann cells cultured with dorsal root ganglion takes two months; two recently published detailed protocols for this procedure will be relied upon (Kleitman et al., Tissue Culture Methods for the Study of Myelination. In Culturing Nerve Cells, Bank et al. (eds.) Cambridge, Mass.:MIT Press [1998] pp. 545-658; Li, *Methods Cell Biol* 57:167 (1998)). Proliferation will be measured by counting Schwann cells. Any effect of tramdorin expression on the rate of myelination will be measured by any of the following four methods: 1) Sudan black staining; 2) myelin basic protein (MBP) or P0 immunohistochemistry; 3) thin-layer chromatography to measure the amounts of myelin-specific lipids (Vitiello et al., *J Chromatogr* 166:637 (1978)); or 4) fluorescent ceramide incorporation (Bilderback et al., *J Neurosci Res* 49:497 (1997); Chan et al., *PNAS USA* 95:10459 (1998)).

Briefly, the uterus is removed from female rats that are 14-15 days pregnant (plug day is designated as day 0 of pregnancy) in order to obtain embryonic Schwann cells. Thereafter, the embryos are removed from the uterus. Using a dissecting microscope, the entire length of spinal cord is exposed. Dorsal root ganglia (DRGs) are removed from both sides of the spinal cord using forceps. The DRGS are put into culture with collagenase at 37 C for 30-45 minutes, washed and resuspended in HamsF12/DMEM medium (1:1 mixture) supplemented with growth factors. The cell suspension is then placed in 24-well plates that have been coated with natural mouse laminin.

Postnatal day 0-1 rats are used for the preparation of neonatal rat Schwann cells and the dissociation of DRGs is performed with collagenase as described above. Adult rat Schwann cells are usually prepared from young adult rats 60-90 days old. The dissociation is performed with a 10% collagenase/dispase solution at 37 C for 45 minutes. Human Schwann cells can be prepared from donated organs. The sural nerve is particularly useful. Again, dissociation is achieved with mild enzyme treatment and culturing is done on laminin-coated plates.

After three days, the cultures on laminin will form a confluent monolayer of rapidly dividing Schwann cells. The cells can be subcultured every 4 days at a 1:4 split ratio.

To obtain neurons for coculture with Schwann cells for remyelination, a portion of the dissociated DRGs (after washing but before culturing) are placed in a tube with a 5% BSA layer and centrifuged such that the cloudy cell suspension stays on top of the layer (and is discarded) and the pellet is recovered, treated with a 0.125% trypsin solution, washed and resuspended. The recovered material can be further purified on another 5% BSA layer at 1 g. The neurons are grown in the laminin-coated wells in F12/DMEM supplemented with 5 ng/ml neurotropin 3 and 15% fetal bovine serum.

To test the effects of tramdorin expression on Schwann cell proliferation, differentiation, and survival, tramdorin proteins will be expressed in cultured primary Schwann cells using retroviral vectors. Retroviral infection of Schwann cells has several advantages. First, the ability to transfect primary Schwann cells with retroviral vectors is well established, and infected cells can myelinate (Howe et al., *J Neurosci Methods* 83:133 1998; Owens, *Ann NY Acad Sci* 633:543 (1991); Owens et al., *Development* 112:639 (1991); Owens et al., *J Cell Biol* 111:1171 (1990); Owens et al., *Neuron* 7:565 (1991); Zoidl et al., *Embo J* 14:1122 (1995)). Second, the introduced DNA integrates into the genome, generating a stably transfected cell. To constitutively express exogenous genes in primary Schwann cells, a dicistronic retroviral system, LIRES-GFP, that permits myelination of infected primary Schwann cells (Howe et al., *J Neurosci Methods* 83:133 (1998)) will be used. The LIRES-GFP vector has been kindly provided by K. McCarthy. The reading frames will be inserted into the LIRES-GFP vector, after addition of Kozak start sites, and C-terminal HA tags. The pBKS plasmid (Stratagene) has been modified to generate a convenient shuttle vector for adding these sequences. Retroviruses will be made using the Ecopak ecotropic cell line (Clontech) that permits infection of only rat or mouse cells. After infection of primary Schwann cells with tramdorin retroviruses, the effects of tramdorin expression on Schwann cell proliferation, and on the expression of Oct-6 and myelin P0, will be measured, using antisera specific for these proteins (Bermingham et al., *Gene Develop* 10:1751 (1996); Scherer et al., *J Neurosci* 15:8281 (1995)). Any effects of its expression in the presence and absence of the putative tramd ligand GABA will be measured.

Myelinating Schwann cell lines may provide an alternative to the use of primary Schwann cell lines. Two myelinating Schwann cell lines have been reported. The SCL4.1/F7 cell line was generated by multiple passaging of primary Schwann cells with intermittent exposure to cholera toxin (Haynes et al., *J Neurosci Methods* 52:119 (1994)). CR1b4 is a Schwann cell line that was immortalized using a temperature sensitive oncogene (Thi et al., *J Exp Biol* 201:851 (1998)).

C. Generation of Mice that Lack Tramdorin Genes

To determine the extent to which tramdorin expression is required for peripheral myelination, mice that lack the tramd1 gene (SEQ ID NO:7) will be generated. Two distinct mutations will be made. The first will generate a conditional knockout of the tramdorin1 gene (SEQ ID NO:7), in which tramdorin 1 is deleted only in Schwann cells. This approach is based on use of the bacteriophage site-specific recombinase Cre, which recognizes 34 bp loxP sites (reviewed in (Sauer, *Methods* 14:381 (1998)). To generate a mouse in which a gene is deleted in a specific tissue (reviewed in (Marth, *J Clin Invest* 97:1999 (1996)), the region to be deleted is flanked by loxP sites. For tramdorin1, exon 2 will be flanked with loxP sites, thereby permitting its specific deletion in the presence of Cre recombinase. Such a deletion will remove conserved (and therefore presumably important) sequences, and will cause the remainder of the tramdorin message to be shifted out of frame. Because the two loxP sites are located in the introns surrounding exon2, the mutation will have no effect in the absence of Cre recombinase. Such "floxed" mice will be crossed to transgenic mice in which Cre recombinase is expressed under control of the P0 promoter (Feltri et al., *Ann NY Acad Sci* 883:116 (1999); Giovannini et al., *Genes Dev* 14:1617 (2000); Yamauchi et al., *Dev Biol* 212:191 (1999)). Mice that carry both the transgene, and are homozygous for the floxed tramdorin1 allele will have the tramdorin gene specifically mutated in Schwann cells. That is to say, it will take another backcross to the floxed mouse to get homozygous floxed and the transgene.

The second mutation will fuse the *E. coli* LacZ gene in frame to tramdorin1 exon 2, thereby truncating the protein and permitting its expression to be monitored by β-galactosidase activity.

D. Screening for Tramd Interacting Proteins

Although a precise understanding of the mechanism of tramdorin action is not required for the practice of the present invention, it is hypothesized that tramdorin is required for proper myelination. Tramdorin may transduce a signal from axons that promotes myelination, and therefore may be a crucial reagent in the identification of the myelinogenic signal itself (see Identification of Tramdorin Ligands, above). Alternatively, tramd1 may interact directly with molecules that are expressed on the surface of axons, or it could act as a cofactor for other Schwann cell signaling molecule(s). Thus, identification of proteins which interact with tramdorins (especially tramdorin 1) is likely to contribute to an understanding of the myelination process. A number of methods are available to detect protein-protein interactions, including but not limited to co-immunoprecipitation, affinity chromatography with immobilized tramdorin 1 protein or fragments or portions of the tramdorin 1 protein, the yeast two-hybrid system and cross-linking. Any suitable method for detection of tramdorin-interacting proteins is contemplated, including the yeast-two hybrid screen and its variations.

Yeast two-hybrid screening (Fields et al., *Nature* 340:245 (1989); U.S. Pat. No. 5,667,973, herein incorporated by reference) is an important approach for identifying protein-protein interactions (reviewed in (Fields et al., *Trends Genet* 10:286 (1994)). Typically, a protein of interest, the bait, is fused to the DNA binding domain of yeast Gal4, or *E. coli* LexA. A library of targets, or "prey" are fused to a transcriptional activator. The bait and prey fusion proteins are coexpressed, and if they interact, marker genes, which contain a binding site for the DNA-binding domain, are expressed that permit isolation of plasmids that encode the interacting protein. The marker gene may encode an enzyme or other product that can be readily measured. Such measurable activity may include the ability of a cell to grow only when the marker gene is transcribed, the presence of detectable enzymatic activity (e.g. β-galactosidase encoded by the LacZ gene) only when the marker gene is transcribed, or light release, depending on the type of reporter or marker gene activated. Commercially available kits for yeast two-hybrid screening are available from Clontech and Stratagene. However, because the bait and prey proteins are imported to the nucleus, the standard yeast two-hybrid methodology precludes posttranslational protein modifications that may be critical for some protein-protein interactions. Furthermore, membrane proteins are underrepresented among interacting protein pairs that have been found by two-hybrid screening (Uetz et al., *Nature* 403:623 (2000)). Recently, a new yeast two-hybrid system, the Ras recruitment system (RRS), has been developed that utilizes a cytoplasmic interaction to activate a Ras signaling pathway (reviewed in (Broder et al., *Curr Biol* 8:1121 (1998)). U.S. Pat. No. 5,776,689, herein incorporated by reference, also describes the protein recruitment system to detect protein-protein interaction at or in a specific cell compartment. A yeast two hybrid system, CytoTrap, that is based on RRS methodology, is available from Stratagene. Briefly, this system involves the complementation of a temperature-sensitive mutation in the yeast cdc25 gene, the yeast homolog for hSos, by proper localization of human Sos to the plasma membrane by protein-protein interaction. A library of target proteins are expressed as fusion proteins with src myristylation sites that anchor the proteins to the membrane. The bait is fused to human Sos, and interaction with target proteins localizes Sos to the membrane, thereby permitting cell survival and growth at 37° C. by activation of the Ras signaling pathway. Thus, when the cDNA library and the tramd1-hSos fusion construct are transformed into the cdc25H yeast strain (Stratagene), the only cells capable of growing at 37° C. on galactose medium are those that have been rescued by a protein-protein interaction recruiting hSos to the cell membrane.

A reverse RRS technique permits full length transmembrane domain proteins to be used as bait (Hubsman et al., *Nucleic Acids Res* 29:E18 (2001)), has recently been described. This reverse RRS system is contemplated herein for the isolation of proteins that interact with tramdorins. Full-length tramdorin will be expressed in yeast whereas the prey will be fused to a mutant Ras protein that lacks a membrane localization signal and stop codon. Those fusion proteins that interact with tramdorin will be localized to the membrane, thereby permitting growth at restrictive temperature of yeast that carry the temperature-sensitive Cdc25-2 mutation.

Although a precise understanding of the localization of tramdorin is not required for the practice of the invention, it is possible that tramdorin may be localized to lysosomes. If this is the case, then the recruitment of Ras activity to lysosomes may not properly activate ras signaling pathways using the reverse RRS technique. Therefore, conventional yeast two-hybrid screening for tramdorin-interacting proteins is also contemplated. The following two baits will be used in the conventional screening:

(i) the N-terminal 51 amino acids of mouse tramdorin1:

MSVTKSARSPQVATPLNLDLPE-SAKKLQSQDPSPANGTSSESSKKTKGITG (SEQ ID NO:15)

This is encoded by the DNA sequence:

(SEQ ID NO:45)
ATG TCT GTG ACC AAG AGT GCC AGG AGT CCG CAG GTA

GCC ACC CCT CTC AAT CTG GAC CTT CCT GAG AGT GCC

AAG AAG CTG CAG AGC CAG GAT CCC AGT CCA GCG AAT

GGG ACC TCT TCA GAG TCA TCA AAG AAG ACC AAG GGC

ATA ACC GGG (ii) the first putative intracellular loop of mouse tramdorin 1, which consists of the following 39 amino acid sequence:

RCAQRFCHRLNKPFMDYGDTVMHGLAF-SPNAWLQNHAHW (SEQ ID NO:16)

This is encoded by the DNA sequence:

(SEQ ID NO:46)
AGA TGT GCC CAG CGC TTC TGT CAC AGA CTG AAC AAG

CCT TTC ATG GAC TAT GGG GAC ACA GTG ATG CAC GGA

CTG GCT TTC AGT CCC AAT GCC TGG CTG CAA AAC CAC

GCC CAC TGG

These are the largest amino acid sequences within the tramdorin 1 protein that do not contain predicted transmembrane domains. The N-terminal 51 amino acids have proven to be toxic when expressed in E. coli. If the same holds true in yeast, the intracellular loop bait will be used. DNA sequences that encode the baits will be cloned into pSos (Stratagene) for RRS two hybrid screening, or pBD-Gal4 (Stratagene) for conventional Gal4-based yeast two hybrid screening, or pLexA (Clontech) for conventional yeast two-hybrid screening based on LexA.

For both the RRS and conventional yeast two-hybrid screening the library of prey interacting proteins will be derived from an adult mouse sciatic nerve cDNA library that will be constructed as follows: Sciatic nerves have been collected from adult male FVB/NJ mice (these are available free of charge). Total RNA has been isolated from the sciatic nerves by $CsCl_2$ gradient centrifugation (Chirgwin et al., Biochem 18:5294 (1979)). cDNA will be synthesized from poly $A^+$ purified RNA using Superscript cDNA synthesis kit (Gibco-BRL), and cloned into the pYes2 (Invitrogen) for reverse RRS screening, the yeast two hybrid library plasmid pMyr (Stratagene) for RRS screening, or pAD-Gal4-2.1 (Stratagene) for conventional Gal4-based yeast two hybrid screening, or pB42AD (Clontech) for conventional yeast two hybrid screening based on LexA.

By way of example of selection and screening for protein-protein interactions, in the Stratagene system, as described by the manufacturer, yeast (strain YRG-2; Matα, ura3-52, his3-200, ade2-101, lys2-801, trp1-901, leu2-3 11, gal4-542, gal80-538, LYS2::$UAS_{GAL1}$-$TATA_{GAL1}$-HIS3 URA3:: $UAS_{GAL4\ 17mers(x3)}$-$TATA_{CYC1}$-lacZ) can be transformed with the pBD-GAL4/protein of interest fragment (i.e. tramd 1 in one embodiment contemplated herein) vector and the mouse sciatic nerve cDNA library contained in the pAD-GAL4-2.1 vector and selected on plates that lack leucine (selection for the pAD-GAL4-2.1 vector) and tryptophan (selection for the pBD-GAL4 vector), and screening can be done by virtue of the histidine and LacZ reporter genes in YRG-2.

E. Analysis of Tramdorin Gene Expression Patterns

1. Tissue Preparation

The spatial and temporal expression patterns of the tramdorin genes were identified by in situ hybridization using radiolabelled RNA probes that specifically recognize individual tramdorin genes. For in situ hybridization, tissue sections were obtained as follows. Mice were anesthetized and perfused with 4% paraformaldehyde or formalin. Hindquarters were dissected to expose the nerve, then stored at 4° C. in 4% paraformaldehyde or formalin, then processed as follows. Tissues were frozen in a 1:1 mixture of OCT and Aquamount, and sectioned at 20 microns.

2. In Situ Hybridization

Figure 28:
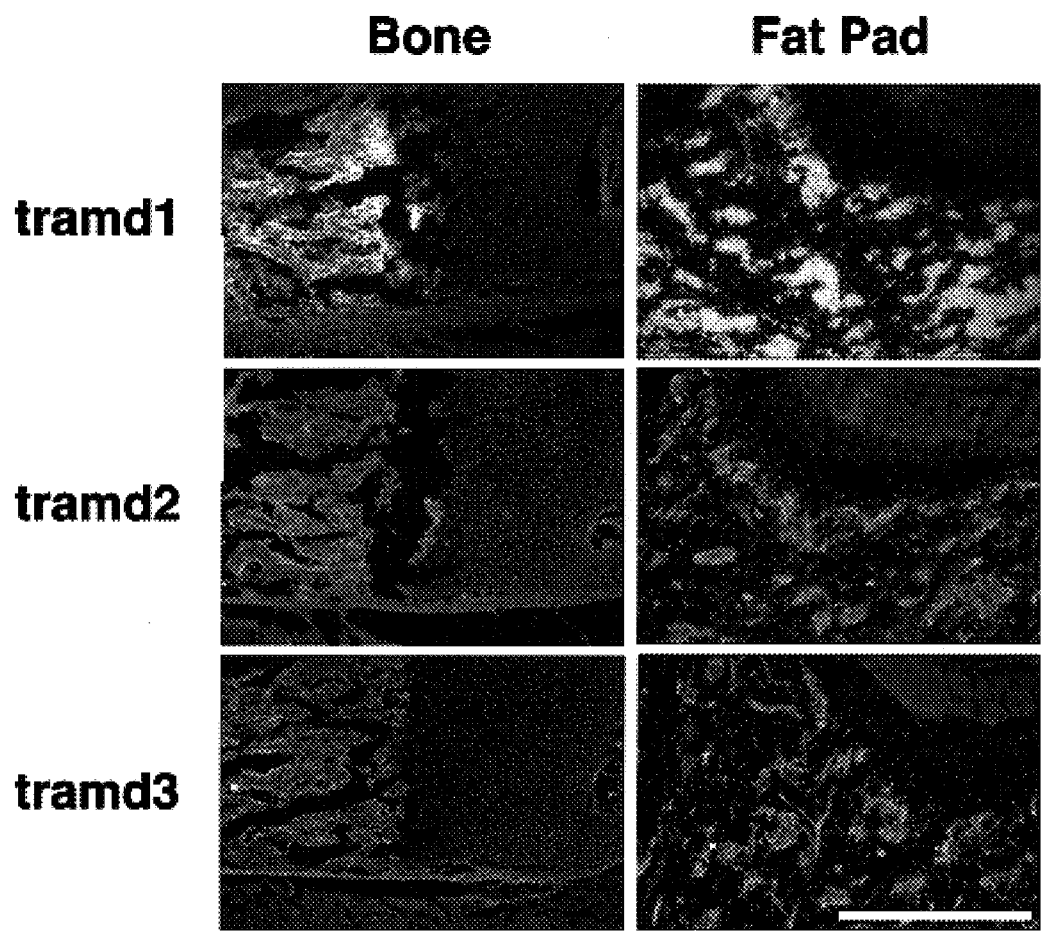
FIG. 28 depicts darkfield micrographs of mouse bone and fat pad tissue hybridized with probes specific for tramd1, tramd2, and tramd3.

In situ hybridization was performed as described by Simmons et al., J. Histotechnology 12:169 (1989). Darkfield micrographs of adjacent sections of P0 mouse leg (prepared as described in the previous section) containing femur and fat pad were hybridized with $^{35}S$ labeled probes specific for tramd1, tramd2 or tramd3. As seen in FIG. 28, the tramd1 probe hybridized to fat pads, and to bone marrow, but not to growth plate. No hybridization to either tissue was detected for tramd2 or tramd3. While it is not intended that the present invention be limited to any specific mechanism, these data suggest a role for glycine signaling in the differentiation of bone and fatty tissue. The probes consist of 343 nt between nucleotides 1549 and 1892 of mouse tramdorin1 cDNA AF512429; 347 nt between nucleotides 2 and 349 of mouse tramdorin 2 cDNA, and 323 nt between nucleotides 1506 and 1829 of mouse tramdorin 3 cDNA. Scale bar: 500 microns.

It has been shown that that bone has NMDA (N-methyl-D-aspartate) receptors. See, Gu et al., "Expression Of Functional Metabotropic Glutamate Receptors In Primary Cultured Rat Osteoblasts", J. Biol. Chem., Vol. 275, pp. 34252-34259 (2000). In one embodiment of the present invention, therefore, it is contemplated that tramdorins may be used as a marker in bone. In another embodiment, it is contemplated that tramdorins may be administered to a subject to modulate the proliferation and differentiation of bone cells (including, but not limited to, osteoblasts and osteoclasts).

In one embodiment of the present invention, it is contemplated that tramdorins may be used as a marker in adipose tissue. In another embodiment, it is contemplated that tramdorins may be administered to a subject to modulate the proliferation of fat cells (including, but not limited to, adipocytes) and the incorporation of glycine into fat cells.

3. Preparation of Probes Specific for Tramd1, Tramd2 and Tramd3

The probes used in the in situ hybridization reactions, as depicted in FIG. 31, were prepared as follows.

Mouse tramdorin1 probe (SEQ ID NO: 71). Mouse tramd1 sequences, shown in bold, were amplified by PCR, and cloned into pCRII (Invitrogen). The insert was excised using EcoRI and cloned into the EcoRI site of pBKSII+ (Stratagene). EcoRI sites are boxed. The probe is transcribed from the T7 promoter, shown in italics, using T7 polymerase, using plasmid DNA that has been linearized at the HindIII site, which is underlined. The mouse tramdorin1 sequence consists of 343 bp between nucleotides 1549 and 1892 of AF512429, shown in antisense orientation.

Mouse tramdorin2 probe (SEQ ID NO: 72). 347 bp of mouse tramdorin 2 sequences between nucleotides 2 and 349, shown in bold, were amplified by PCR, and cloned into pCRII (Invitrogen) They are shown in antisense orientation. EcoRI sites are boxed. The probe was transcribed from the T7 promoter, shown in italics, using T7 polymerase, using plasmid DNA that has been linearized at the BamHI site, which is underlined.

Mouse tramdorin3 probe (SEQ ID NO; 73). 323 bp of mouse tramdorin3 sequences between nucleotides 1506 and 1829 of mouse tramdorin3 composite cDNA 50+61−45+76, shown in bold, were amplified by PCR, and cloned into pCRII (Invitrogen). They are shown in antisense orientation. EcoRI sites are boxed. The probe was transcribed from the T7 promoter, shown in italics, using T7 polymerase, using plasmid DNA that has been linearized at the BamHI site, which is underlined.

4. Tramdorin Antiserum i. Preparation

Antisera against tramdorin proteins permit their subcellular localization to be determined by immunohistochemistry and confocal microscopy. Antisera were raised in two rabbits against the mouse tramdorin 1 C-terminal peptide CGTYQALDELIKSGNSPA (SEQ ID NO:47). The antisera were affinity purified using a Sulfolink column (Pierce) that contained covalently bound peptide. However, the antisera showed extremely weak signals on tissue sections under a variety of conditions. To obtain antisera that provide better signal on tissue sections, a synthetic peptide: ESAKKLQSQDPSPANGTSC (SEQ ID NO: 74), containing amino acids 22-39 near the N-terminus of tramdorin1, was coupled to KLH and injected into two rabbits, one of which generated useful antiserum. It should be noted that the C-terminal cystine is used for linkage to KLH.

In other embodiments alternative approaches, such as expression the N-terminus as a GST fusion protein or to generate antisera against synthetic peptide(s) that correspond to this region, may be used.

While the cloning of this tramdorin 1 N-terminus expression plasmid has proven to be non-trivial, there are viable alternative strategies to obtain antisera against the N-terminus of mouse tramdorin 1. By way of non-limiting example, the N-terminus can be expressed as a GST-fusion protein, which permits purification of the fusion on an affinity column. The GST portion of the fusion can be removed before injection into animals for antisera generation, or the entire fusion can be used to generate antiserum, as long as the antiserum is affinity cleared of any GST-reactive antibodies before use in localization studies. Another strategy is to generate antisera against synthetic peptide(s) that correspond to this region. Such synthetic peptides can be chemically prepared by methods well known in the art, and do not require expression in a host organism.

The present invention provides isolated antibodies. An antibody against a protein of the present invention (i.e. a tramdorin protein or fragment or portion of a tramdorin protein) may be any monoclonal or polyclonal antibody, as long as it can recognize the protein of interest. Antibodies can be produced by using a protein, or fragment thereof, or synthetic peptide, of the present invention as the antigen according to a conventional antibody or antiserum preparation process.

The present invention contemplates the use of both monoclonal and polyclonal antibodies. Any suitable method may be used to generate the antibodies used in the methods and compositions of the present invention, including but not limited to, those disclosed herein. For example, for preparation of a monoclonal antibody, protein, as such, or together with a suitable carrier or diluent is administered to an animal (e.g., a mammal) under conditions that permit the production of antibodies. For enhancing the antibody production capability, complete or incomplete Freund's adjuvant may be administered. Normally, the protein is administered once every 2 weeks to 6 weeks, in total, about 2 times to about 10 times. Animals suitable for use in such methods include, but are not limited to, primates, rabbits, dogs, guinea pigs, mice, rats, sheep, goats, etc.

For preparing monoclonal antibody-producing cells, an individual animal whose antibody titer has been confirmed (e.g., a mouse) is selected, and 2 days to 5 days after the final immunization, its spleen or lymph node is harvested and antibody-producing cells contained therein are fused with myeloma cells to prepare the desired monoclonal antibody producer hybridoma. Measurement of the antibody titer in antiserum can be carried out, for example, by reacting the labeled protein, as described hereinafter and antiserum and then measuring the activity of the labeling agent bound to the antibody. The cell fusion can be carried out according to known methods, for example, the method described by Koehler and Milstein [Nature 256:495 (1975)]. As a fusion promoter, for example, polyethylene glycol (PEG) or Sendai virus (HVJ), preferably PEG, is used.

Examples of myeloma cells include NS-1, P3U1, SP2/0, AP-1 and the like. The proportion of the number of antibody producer cells (spleen cells) and the number of myeloma cells to be used is preferably about 1:1 to about 20:1. PEG (preferably PEG 1000-PEG 6000) is preferably added in concentration of about 10% to about 80%. Cell fusion can be carried out efficiently by incubating a mixture of both cells at about 20° C. to about 40° C., preferably about 30° C. to about 37° C. for about 1 minute to 10 minutes.

Various methods may be used for screening for a hybridoma producing the antibody (e.g., against a tramdorin protein or portion thereof). For example, where a supernatant of the hybridoma is added to a solid phase (e.g., microplate) to which protein is adsorbed directly or together with a carrier, and then an anti-immunoglobulin antibody (if mouse cells are used in cell fusion, anti-mouse immunoglobulin antibody is used) or Protein A labeled with a radioactive substance or an enzyme is added to detect the monoclonal antibody against the protein bound to the solid phase. Alternately, a supernatant of the hybridoma is added to a solid phase to which an anti-immunoglobulin antibody or Protein A is adsorbed and then the protein labeled with a radioactive substance or an enzyme is added to detect the monoclonal antibody against the protein bound to the solid phase.

Selection of the monoclonal antibody can be carried out according to any known method or its modification. Normally, a medium for animal cells to which HAT (hypoxanthine, aminopterin, thymidine) are added is employed. Any selection and growth medium can be employed as long as the hybridoma can grow. For example, RPMI 1640 medium containing 1% to 20%, preferably 10% to 20% fetal bovine serum, GIT medium containing 1% to 10% fetal bovine serum, a serum free medium for cultivation of a hybridoma (SFM-101, Nissui Seiyaku) and the like can be used. Normally, the cultivation is carried out at 20° C. to 40° C., preferably 37° C. for about 5 days to 3 weeks, preferably 1 week to 2 weeks under about 5% $CO_2$ gas. The antibody titer of the supernatant of a hybridoma culture can be measured according to the same manner as described above with respect to the antibody titer of the anti-protein in the antiserum.

Separation and purification of a monoclonal antibody (e.g., against tramdorin or a fragment of tramdorin) can be carried out according to the same manner as those of conventional polyclonal antibodies such as separation and purification of immunoglobulins, for example, salting-out, alcoholic precipitation, isoelectric point precipitation, electrophoresis, adsorption and desorption with ion exchangers (e.g., DEAE), ultracentrifugation, gel filtration, or a specific purification method wherein only an antibody is collected with an active adsorbent such as an antigen-binding solid phase, Protein A or Protein G and dissociating the binding to obtain the antibody.

Polyclonal antibodies may be prepared by any known method or modifications of these methods including obtaining antibodies from patients. For example, a complex of an immunogen (an antigen against the protein) and a carrier protein is prepared and an animal is immunized by the complex according to the same manner as that described with respect to the above monoclonal antibody preparation. A material containing the antibody against is recovered from the immunized animal and the antibody is separated and purified.

As to the complex of the immunogen and the carrier protein to be used for immunization of an animal, any carrier protein and any mixing proportion of the carrier and a hapten can be employed as long as an antibody against the hapten, which is crosslinked on the carrier and used for immunization, is produced efficiently. For example, bovine serum albumin, bovine cycloglobulin, keyhole limpet hemocyanin, etc. may be coupled to an hapten in a weight ratio of about 0.1 part to about 20 parts, preferably, about 1 part to about 5 parts per 1 part of the hapten.

In addition, various condensing agents can be used for coupling of a hapten and a carrier. For example, glutaraldehyde, carbodiimide, maleimide activated ester, activated ester reagents containing thiol group or dithiopyridyl group, and the like find use with the present invention. The condensation product as such or together with a suitable carrier or diluent is administered to a site of an animal that permits the antibody production. For enhancing the antibody production capability, complete or incomplete Freund's adjuvant may be administered. Normally, the protein is administered once every 2 weeks to 6 weeks, in total, about 3 times to about 10 times.

The polyclonal antibody is recovered from blood, ascites and the like, of an animal immunized by the above method. The antibody titer in the antiserum can be measured according to the same manner as that described above with respect to the supernatant of the hybridoma culture. Separation and purification of the antibody can be carried out according to the same separation and purification method of immunoglobulin as that described with respect to the above monoclonal antibody.

The protein used herein as the immunogen is not limited to any particular type of immunogen. For example, tramdorin can be used as the immunogen. Further, fragments of the protein may be used, including but not limited to the amino terminus of tramdorin. Fragments may be obtained by any methods including, but not limited to expressing a fragment of the gene, enzymatic processing of the protein, chemical synthesis, and the like.

V. Tramdorins and Parathyroid Tumors

As noted above, a fourth human tramdorin-related sequence, tramdL, is defined by the EST cDNA 1388139 (SEQ ID NO:23) (FIGS. 8D and 12). tramdL contains only sequences that are homologous to exon 10 of tramdorin1. This cDNA is derived from a parathyroid adenoma, and is unusual in that its 5' end consists of sequences derived from a member of the STE20 family of kinases, STK4/Mst-1/Krs-2 (FIGS. 11A-B; Creasy et al., *J Biol Chem* 270:21695 (1995); Taylor et al., *PNAS USA* 93:10099 (1996)), located on human chromosome 20. The STK4/Mst-1/Krs-2 cDNA fragment is fused to 3' sequences of tramdL FIG. 11C, located on chromosome 5. Comparison of the genomic sequences for STK4/Mst-1/Krs-2 and tramdL reveal that the fusion site corresponds to a 5' splice site in the STK4/Mst-1/Krs-2 gene, and a 3' splice site in tramdL FIG. 11D. Such a fusion is unlikely to be an artifact of cDNA synthesis. While an understanding of the precise mechanism is not necessary to the practice of the invention, and noting that the invention is not to be limited to any particular mechanism, this observation raises the possibility that tramdL resides near a parathyroid tumor translocation breakpoint, between chromosomes 20 and 5, that results in expression of a STK4/Mst-1/Krs-2-tramdorinL fusion protein. STK4/Mst-1/Krs-2 contains a C-terminal inhibitory domain (Creasy et al., *J Biol Chem* 271:21049 (1996)) that is cleaved by Caspase-3 to generate a cleavage product, p36, with kinase activity (Graves et al., *Embo J* 17:2224 (1998); Lee et al., *Oncogene* 16:3029 (1998); Watabe et al., *J Biol Chem* 275:8766 (2000)). The STK4/Mst-1/Krs-2-tramdorinL fusion protein would replace STK4/Mst-1/Krs-2 C-terminal sequences with a C-terminal transmembrane domain from tramdL FIG. 11E. Based on the activity of C-terminal deletions of STK4/Mst-1/Krs-2 (Creasy et al., *J Biol Chem* 271:21049 (1996)), the fusion protein may retain kinase activity, and may represent an important aspect of the etiology of parathyroid tumors.

In one embodiment of the present invention, it is contemplated that tramdorins may be used as a marker in bone. In another embodiment of the present invention, it is contemplated that tramdorins may be administered to a subject to modulate the proliferation and differentiation of bone cells (including, but not limited to, osteoblasts and osteoclasts).

A. Parathyroid Adenoma Background

Primary hyperparathyroidism is a disorder of the parathyroid glands. Most people with this disorder have one or more enlarged, overactive parathyroid glands that secrete too much parathyroid hormone. The parathyroid glands are four pea-sized glands located on the thyroid gland in the neck. The parathyroid glands secrete parathyroid hormone (PTH), a hormone that helps maintain the correct balance of calcium and phosphorus in the body. PTH regulates the release of calcium from bone, absorption of calcium in the intestine, and excretion of calcium in the urine. When the amount of calcium in the blood falls too low, the parathyroid glands secrete just enough PTH to restore the balance.

If the glands secrete too much hormone, as in hyperparathyroidism, the balance is disrupted: blood calcium rises. This condition of excessive calcium in the blood, called hypercalcemia, is what usually signals the doctor that something may be wrong with the parathyroid glands. In 85 percent of people with this disorder, a benign tumor (an adenoma) has formed on one of the parathyroid glands, causing it to become overactive. The excess PTH triggers the release of too much calcium into the bloodstream. The bones may lose calcium, and too much calcium may be absorbed from food. The levels of calcium may increase in the urine, causing kidney stones. PTH also acts to lower the blood phosphorus levels by increasing excretion of phosphorus in the urine.

In the United States, about 100,000 people develop hyperparathyroidism each year. Women outnumber men by 2 to 1, and risk increases with age. In women 60 years of age and older, 2 out of 1,000 will get hyperparathyroidism. Primary hyperparathyroidism is found in up to 2.1% of postmenopausal women (Lundgren et al., *Surgery* 121:287 (1997)). A person with hyperparathyroidism may have severe symptoms, subtle symptoms, or no symptoms at all. Routine blood tests that screen for high calcium levels are alerting doctors to people who, though symptom-free, have mild forms of the disorder. When symptoms do appear, they are often mild and nonspecific, such as feelings of weakness and fatigue, depression, or aches and pains. With more severe disease, a person may have a loss of appetite, nausea, vomiting, constipation, confusion or impaired thinking and memory, and increased thirst and urination. Patients may have thinning of the bones without symptoms, but with risk of fractures. Increased calcium and phosphorus excretion in the urine may cause kidney stones. Subjects with hyperparathyroidism may be more likely to develop peptic ulcers, high blood pressure, and pancreatitis.

Hyperparathyroidism is diagnosed when tests show that blood levels of calcium as well as parathyroid hormone are too high. Once the diagnosis is established, other tests may be done to assess complications. Because high PTH levels can cause bones to weaken from calcium loss, a measurement of bone density may be done to assess bone loss and the risk of fractures. Abdominal radiographs may reveal the presence of kidney stones and a 24-hour urine collection may provide information on kidney damage and the risk of stone formation.

At the present time, surgery to remove the enlarged gland is the only treatment for the disorder. While surgery is an effective cure in 95% of cases, by nature, surgery is invasive and carries risks of complications, including but not limited to post-surgical infection. Some patients who have mild disease may not need immediate treatment. Such patients are subject to long-term monitoring which includes regular testing of calcium levels, bone mass and kidney function. Such subjects must avoid certain medications (such as diuretics such as the thiazides) and consult a physician in cases of immobilization or gastrointestinal disease with vomiting and diarrhea, which can cause calcium levels to rise. Thus, a non-invasive therapeutic, an animal model to test such therapeutics, and a diagnostic test to determine the presence of certain genomic rearrangements in parathyroid adenomas to direct the therapeutic regimen would all be useful.

At the present time, the underlying molecular genetic pathology of parathyroid adenomas is not fully understood. In a subset of parathyroid adenomas, a tumor-specific DNA rearrangement (a pericentromeric inversion, inv(11)(p15; q13)) which results in the fusion of the cyclin D1 gene (CCND1) with the parathyroid hormone regulatory region is found. Immunohistochemistry has shown that cyclin D1 is overexpressed in 20-40% of parathyroid adenomas. However, other (non cyclin dependent) mechanisms may account for parathyroid cell proliferation in the remaining cases (see for example, Mallya et al., *Frontiers in Bioscience* 5:d367-371 (2000)). Mallya et al. (supra) also note that mice which harbor a transgene in which the cyclin D1 gene is placed under the control of the parathyroid hormone (PTH) regulatory region (to mimic the chromosome 11 rearrangement and resultant cyclin D1 overexpression in the human tumors) develop hyperparathyroidism by the age of six months, as evidenced by parathyroid enlargement and increased serum calcium and parathyroid hormone levels. Thus, tissue specific expression of cyclin D1 does induce parathyroid cell proliferation resulting in hyperparathyroidism. However, this etiology is only likely to account for 20-40% of parathyroid adenomas.

B. Tramdorins in Parathyroid Adenomas

While not limited to any particular mechanism, and with the note that an understanding of the underlying mechanism is not necessary to the practice of the invention, the identification of a putative STK4/Mst-1/Krs-2-tramdorinL fusion gene that is derived from parathyroid adenomas suggests that a membrane-bound, constitutively active kinase may function in the etiology of these tumors. Parathyroid adenoma DNA has been examined for allelic loss (Tahara et al., *Cancer Res* 56:599 (1996)), or chromosome gain or loss (Palanisamy et al., *J Clin Endocrinol Metab* 83:1766 (1998)), as an approach to identifying parathyroid tumor suppressor genes, but these studies would not necessarily detect translocations. The putative STK4/Mst-1/Krs-2-tramdorinL fusion gene is suggestive of a t(20;5) translocation in at least one parathyroid adenoma. STK4/Mst-1/Krs-2 has been shown to be activated by apoptotic signals (Graves et al., *Embo J* 17:2224 (1998); Lee et al., *Oncogene* 16:3029 (1998); Watabe et al., *J Biol Chem* 275:8766 (2000)), and its active proteolytic fragment has been found in several tumor cell lines (Watabe et al., *J Biol Chem* 275:8766 (2000), but its physiological role is not understood. If the putative truncated, membrane-bound form of the kinase contributes to the etiology of parathyroid adenomas, it may provide avenues toward new therapies for a disorder that will increase in frequency in the United States as the average age of Americans increases.

A number of means are contemplated for determining the role of the putative STK4/Mst-1/Krs-2-tramdorinL fusion gene in parathyroid adenomas, and the invention is not intended to be limited to any particular means of evaluating the putative STK4/Mst-1/Krs-2-tramdorinL fusion gene in parathyroid adenomas. For example, DNA-based assays are contemplated, wherein the fusion is detected by PCR amplification of cDNA from parathyroid adenomas using primers corresponding to the tramdL portion of the fusion and the STK4/Mst-1/Krs-2 portion of the fusion, such that amplification will occur across the fusion junction if the fusion is present, but no amplification will occur in the absence of the fusion. RNA will be isolated from several independent parathyroid adenomas, as well as other parathyroid tumors, and RT-PCR will be carried out using primers that correspond to tramdL sequences. The cDNAs that will be obtained from these tissues will determine if the fusion transcript is present in parathyroid tumor tissue. Limited parathyroid adenoma tissue is available from Research Genetics. Additional samples will be obtained from tissue banks, or other sources, such as local physicians. Primers that can be used to detect the fusion transcript are:

5' TGCCAAAGGAGTGTCAATACTGCG 3' (STK4/Mst-1/Krs-1) (SEQ ID NO:48)

5' TCCCCACCAGAAATCCCACAAAGC 3' (tramdL) (SEQ ID NO:49)

These primers have an optimal annealing temperature of 59° C., and will amplify a 494 bp product from STK4/Mst-1/Krs-1-tramdL fusion cDNAs. Therefore they may also be used for diagnosis of translocations that produce STK4/Mst-1/Krs-1-tramdL fusion transcripts. If fusion cDNAs are detected, primers that correspond to the initiation ATG codon of STK4/Mst-1/Krs-1, and the termination TAG codon of tramdL, or sequences 3' to it, will be used for RT-PCR to amplify the entire STK4/Mst-1/Krs-1-tramdL coding sequence for expression studies.

Molecular cytogenetic analysis, such as FISH, is also contemplated for detection of the presence of the STK4/Mst-1/Krs-2-tramdL fusion in cells harvested from parathyroid tumors. Bacterial artificial chromosomes (BACs) with sequences corresponding to tramdL genomic sequences will be obtained, as will BACs with inserts corresponding to the genomic sequence of STK4/Mst-1/Krs-2. The tramdL and STK4/Mst-1/Krs-2 BACS will be differentially labeled. For example, the tramdL BAC can be labeled with a marker which permits detection of a green fluorescent signal, such as by direct incorporation of fluorescein or FITC, or by incorporation of biotin, which can be detected by FITC-conjugated avidin. The STK4/Mst-1/Krs-2 BAC can be labeled with a marker which permits detection of a red fluorescent signal, such as by direct incorporation of TRITC or by incorporation of digoxigenin, which can be detected by rhodamine-conjugated anti-digoxigenin antibodies. The labeled probes are hybridized to a cytogenetic preparation of an isolated parathyroid tumor, or cultured cells derived from isolated parathyroid tumors. As a normal control, normal parathyroid tissue (or cultured cells) or peripheral blood cells can be used. The probes can be prepared by a number of methods, including PCR amplification and nick translation. Suitable nick translation protocols are provided in Human Chromosomes, Principles and Techniques (2E), Verma and Babu (Ed.) Chapter 6 (pp. 185-231) (1995) and Lichter and Ried "Molecular Analysis of Chromosome Aberrations. In situ Hybridization" pp. 449-478 in Methods in Molecular Biology, Vol. 29: Chromosome Analysis Protocols. Edited by J. R. Godsen. (1994). Following hybridization, washing and detection steps, (as described in Verma and Babu and Lichter and Ried, supra) the specimens are counter-stained with 4',6-diamidino-2-phenyl indole dihydrochloride (DAPI) (to permit visualization of the nuclei and metaphase chromosomes in blue), and observed and imaged on a fluorescence microscope equipped with a mercury or xenon lamp and the appropriate filter sets. In the normal controls, the expected result on an interphase nucleus is two green spots (or two closely juxtaposed "doublets" in nuclei that have replicated their DNA), corresponding to the two tramdL alleles on chromosome 4, and two red spots (or two closely juxtaposed "doublets" in nuclei that have replicated their DNA), corresponding to the two STK4/Mst-1/Krs-2 alleles on chromosome 20. In parathyroid adenomas with a STK4/Mst-1/Krs-2-tramdL fusion, the expected result (in a diploid or near-diploid cell) is a single green spot (or doublet), corresponding to the tramdL allele that is not involved in the fusion, a single red spot (or doublet), corresponding to the STK4/Mst-1/Krs-2 allele that is not involved in the fusion, and a yellowish-orange "fusion spot" resulting from the near super-imposed hybridization of the green tramdL probe and the red STK4/Mst-1/Krs-2 probe hybridizing to the translocation-derived STK4/Mst-1/Krs-2-tramdL fusion.

The detection of "fusion" FISH signals is well known in the art as a means to detect translocations, for example, in the detection of the BCR/ABL rearrangement that fuses the ABL proto-oncogene on chromosome 9 to the BCR (breakpoint cluster region) gene on chromosome 22 and which is frequently present in chronic myelogenous leukemia (CML) (see, for example, "Cellular Genomic Products for Hematopoietic Disorders", available from Vysis, Inc. Downers Grove, Ill., http://www.vysis.com). Using dual-color FISH, the proportion of parathyroid tumors harboring a STK4/Mst-1/Krs-2-tramdL fusion can be determined.

It is also possible, and known in the art to use "chromosome painting" probes to detect translocations in metaphase spreads (see for example, Speicher et al., *Nat Genet* 12:368-375, (1996)). Thus, a whole chromosome paint probe to chromosome 5, and a whole chromosome paint probe to chromosome 20 can be hybridized to metaphase chromosome spreads from parathyroid tumors. Differentially labeled painting probes are commercially available, for example WCP® 20 Spectrum Green™ from Vysis (Downers Grove, Ill.) is a probe which hybridizes to both arms and the centromere of chromosome 20. WCP 5® Spectrum Orange™ from Vysis (Downers Grove, Ill.) hybridizes to both arms and the centromere of chromosome 5. Hybridization of these probes to parathyroid adenomas metaphase spreads (according to the manufacturer's instructions) will reveal the presence of a translocation between chromosome 5 and chromosome 20, in the form of a two-color chromosome. In order to evaluate other rearrangements, spectral karyotyping (SKY) or multi-fluor FISH (Speicher et al., supra; Schrock et al., *Science* 273:494 (1996)) may be carried out. In these methods, a probe "cocktail" with every chromosome labeled with a unique combination of dyes is hybridized to metaphase preparations. Following washing and detection steps, the hybridized and counterstained preparations are imaged on a spectral imaging workstation (for SKY), which determines the spectrum (and hence the dye combination) at each point in the image, allowing unambiguous identification of complex chromosome rearrangements. Thus, any rearrangements involving chromosome 5 (and tramdL sequences) and chromosome 20 (and STK4/Mst-1/Krs-2 sequences) can be identified.

Although an understanding of the mechanism underlying the invention is not necessary to the practice of the invention, it is hypothesized that the STK4/Mst-1/Krs-2-tramdL fusion may be involved in the proliferation of parathyroid tumors, including but not limited to parathyroid adenomas. In order to investigate this role and create an animal model which can be used to investigate therapeutic regimens for parathyroid tumors harboring a STK4/Mst-1/Krs-2-tramdL fusion, transgenic mice in which the STK4/Mst-1/Krs-2-tramdL fusion construct FIG. 23A and FIG. 23B (SEQ ID NO:38) is expressed under control of a promoter that is active in the parathyroid gland are contemplated. Gcm2 is a transcription factor that is expressed primarily, and perhaps exclusively, in parathyroid tissue [Kim et al., *PNAS USA* 95: 12364 (1998)]. Mice will be generated in which the Gcm2 promoter controls expression of the STK4/Mst-1/Krs-2-tramdL fusion gene. These mice will be generated by "knock-in" targeted recombination in embryonic stem cells (ES cells).

The STK4/Mst-1/Krs-2-tramdL fusion protein (SEQ ID NO:44) will be expressed in mice using 5.2 kb of the human Pth promoter region. When overexpressed in parathyroid gland using this DNA fragment, the cyclin D1 gene causes primary hyperparathyroidism in mice (Imanishi, Y., Hosokawa, Y., Yoshimoto, K., Schipani, E., Mallya, S., Papanikolaou, A., Kifor, O., Tokura, T., Sablosky, M., Ledgard, F, Gronowicz, G, Wang, T. C., Schmidt, E. V., Hall, C., Brown, E. M., Bronson, R., and Arnold, A. 2001. Primary hyperparathyroidism caused by parathyroid-targeted overexpression of cyclin D1 in transgenic mice. Journal of Clinical Investigation 107: 1093-1102.)

Alternatively, the Gcm2 coding regions will is replaced with the STK4/Mst-1/Krs-2-tramdL fusion gene. The Gcm2 gene has been inactivated in mice [Gunther et al., *Nature* 406:199-203, (2000)], indicating that mice that carry a single knock-in allele will not be affected by the absence of a single Gcm2 allele. In an alternative embodiment, a "knock-in" of the STK4/Mst-1/Krs-2 into the parathyroid hormone locus is contemplated.

Parathyroid-specific expression of the STK4/Mst-1/Krs-2-tramdL fusion is expected to result in hyperparathyroidism (which can be detected by parathyroid enlargement and increased serum levels of calcium and parathyroid hormone), if, as hypothesized, the STK4/Mst-1/Krs-2-tramdL fusion plays a role in parathyroid tumors. Such mice can then be used in evaluation of therapeutics which may be useful in the management of parathyroid tumors harboring the STK4/Mst-1/Krs-2-tramdL fusion in human subjects VI. Tramdorins and Peripheral Neuropathies As noted above, the human tramdorins map to chromosome 5q31-33. An autosomal recessive Charcot-Marie-Tooth Syndrome demyelinating neuropathy has been mapped to this region [Guilbot et al., *Ann NY Acad Sci* 883:56 (1999a); Guilbot et al., *Eur J Hum Genet* 7:849 (1999b); LeGuern et al., *Hum Mol Genet* 5:1685 (1996)), suggesting that a human tramdorin could be a candidate peripheral neuropathy disease gene. As noted above, a crucial function of Oct-6 in myelination may be activating expression tramdorin 1, a gene that encodes a novel transmembrane domain protein. Of the six target genes for Oct-6 identified thus far, it is the only one that resides near a candidate peripheral neuropathy locus. A search for mutation in families that segregate the chromosome 5q32 peripheral neuropathy (Guilbot et al., *Ann NY Acad Sci* 883:56 (1999a); Guilbot et al., *Eur J Hum Genet* 7:849 (1999b);

LeGuern et al., *Hum Mol Genet* 5:1685 (1996)) is underway. Thus, by focusing on the tramdorins, the target area to look for disease-associated mutations is significantly reduced. If a consistent disease-associated mutation in a tramdorin gene can be identified, that gene can be used in a molecular diagnostic assay, and may also contribute to potential therapies. For example, the identification of the disease-associated mutation in the cystic fibrosis transmembrane conductance regulator (CFTR) gene enabled the development of a diagnostic genetic test, an animal model, and potential gene therapies (see OMIM entry*602421, http://www3.ncbi.nlm.nih.gov/htbin-post/Omim/dispmim?602421 and Chapter 3 of "Human Genetics, A Problem-based Approach", Bruce Korf, Blackwell Science, 1996 for a summary), and a similar outcome is expected should a peripheral neuropathy-associated mutation in a tramdorin be identified.

VII. Remyelination by Schwann Cells in the CNS Following Disease or Injury

Remyelination of axons in the central nervous system (CNS) by Schwann cells has been explored extensively as a possible treatment for demyelinating diseases such as multiple sclerosis, and as a treatment for nerve injury (reviewed in (Duncan et al., *J Anat* 190:35 (1997); Scolding, *Philos Trans R Soc Lond B Biol Sci* 354:1711 (1999); Scolding et al., *Baillieres Clin Neurol* 6:525 (1997)). MS affects 1/1000 Americans, and in people of northern European descent, the frequency is 1/800 (Lynch et al., *Dis Mon* 42:1-55 (1996)); it represents a significant public health problem in the United States and Europe. An understanding of the genes that regulate myelination by Schwann cells is crucial for optimizing their use in remyelination in the CNS. The tramdorin gene may play a crucial role in regulating myelination for the following reasons: First, it is a putative target gene for Oct-6, a transcription factor that is essential for timely peripheral myelination (Bermingham et al., *Gene Develop* 10:1751 (1996); Jaegle et al., *Science* 273:507 (1996)). Second, its expression following nerve injury indicates that it encodes a myelin-related protein. Tramdorin, and/or its putative ligands, may provide avenues for the development of therapeutic agents for the treatment of the effects of demyelination or nerve injury, both in the peripheral and central nervous systems. The ability to identify molecules that promote myelination will significantly enhance the prospects for successfully using Schwann cells, and perhaps oligodendrocytes and olfactory ensheathing cells as well, to mitigate the damage caused by MS and other demyelinating diseases. A significant use of tramdorin will be in identifying such molecules.

VIII. Use of Tramdorin to Relieve Neurogenic and Neuropathic Pain

Pain that arises from the nervous system is termed "neurogenic." Peripheral neurogenic pain may follow transient pressure upon or stretching of a peripheral nerve or root, or reflect sustained damage to a nerve ("neuropathic pain") such as in polyneuropathy, entrapment neuropathy, or after herpes zoster. Neurogenic pain may have a central origin such as stroke, multiple sclerosis, or trauma, especially of the spinal cord.

Correct diagnosis allows tailoring treatment to the pathophysiologic mechanisms that trigger and maintain the painful condition. Assessing the pain location, intensity, quality, time course, precipitating and relieving factors, as well as its impact on physical and psychosocial function is the first step in clinical analysis. Diagnosis depends upon, first, the neuroanatomical distribution of the pain and, second, evidence of sensory dysfunction involving a peripheral nerve, plexus, nerve root or central pathway. If the affected nerve or pathway is mixed motor and sensory, then weakness, muscle atrophy, or reflex abnormalities may be additional clues to neural involvement. The diagnosis may be obvious but sometimes a thorough neurological examination is needed to uncover the neurogenic origin of the pain. A pain drawing made by the patient frequently gives a good indication of the neuroanatomic distribution and quality of the pain.

Impaired sensation is often evident during a careful examination. Sensory dysfunction may be manifested as hypo- and/or hyperesthesia for one or more modalities, increasing pain to normally painful stimuli (hyperalgesia) or pain due to normally nonpainful stimuli (allodynia). Temporal and spatial sensory dysfunction are also common. Abnormal sensory function in neurogenic pain states can, regardless of modality, be described in terms of stimulus strength and sensation magnitude. Hypoesthesia consists of both increased perception threshold and reduced sensation magnitude at suprathreshold stimulus strengths. Occasionally, hypoesthesia occurs without an increase in stimulus detection threshold. Elevated stimulus perception threshold, together with an increase in slope of the magnitude/stimulus relation is typical for the combination of hypo- and hyperesthesia often seen in neurogenic pain states. Evoked sensation hyperpathic syndrome often has a paresthetic or dysesthetic character or is frankly painful instead of the normal sensation evoked by the applied stimulus. Hyperesthesia can also occur separately with a steeper slope, and occasionally (thin line), with a lowered threshold.

Tramdorin1/mPAT2 has been shown to function as a proton-dependent transporter of small amino acids. (See, Boll, M., Foltz, M., Rubio-Aliaga, I., Kottra, G., and Daniel, H. (2002). Functional Characterization of Two Novel Mammalian Electrogenic Proton-dependent Amino Acid Cotransporters. J Biol Chem 277, 22966-73.). It is related to yeast vacuolar and rat lysosomal amino acid transport proteins, but unlike tramdorin3/LYAAT-1, tramdorin1 does not appear to be a lysosomal protein. Tramdorin1 lacks a putative lysosomal targeting motif (an acidic residue located in the C-terminus, −4 to −6 relative to a dileucine, (LL(I,M,V); that is present in tramd3/LYAAT-1 consistent with its failure to co-localize with LAMp1. [see, Sandoval, I. V., Martinez-Arca, S., Valdueza, J., Palacios, S., and Holman, G. D. J Biol Chem 275, 39874-85. (2000).].

Tramdorin1/mPAT2 shows strong specificity for glycine, L-alanine and L-proline, with greatest inward currents generated by glycine. Although it is possible tramdorin1 could provide additional amino acids required for metabolism in the paranodes and incisures, its restricted substrate specificity and expression pattern suggest other function(s). Glycine can act as an inhibitory neurotransmitter in the CNS, and as an agonist of the NMDA class of ionotropic glutamate receptors. Glycine receptors have not been reported in the PNS, but NMDA glutamate receptors have been found on both adult Schwann cells and peripheral axons (Coggeshall and Carlton, 1998; Fink et al., 1999; Kinkelin et al., 2000).

Therefore, in one embodiment, tramdorin1 could inhibit glutaminergic signaling in peripheral nerve by sequestering extracellular glycine. Indeed it has been shown that axonal expression of all three types of ionotropic glutamate receptor increases following peripheral nerve inflammation; these receptors could contribute to the spontaneous discharges that have been observed in rat models of nerve injury and inflammatory pain. Additionally, an increased frequency of spontaneous discharges, with concomitant thermal hyperalgesia and mechanical allodynia, have been observed in saphenous nerves from dysmyelinating prx mutant mice.

See, Gillespie, C. S., Sherman, D. L., Fleetwood-Walker, S. M., Cottrell, D. F., Tait, S., Garry, E. M., Wallace, V. C., Ure, J., Griffiths, I. R., Smith, A., and Brophy, P. J Peripheral demyelination and neuropathic pain behavior in periaxin-deficient mice. Neuron 26, 523-31 (2001).

These mice possess altered Schmidt-Lanterman incisures, and therefore their expression of tramdorin1 may be reduced. In selected embodiments, tramdorin1 may dampen neuronal excitability thereby limiting pain sensitivity. In other embodiments, tramdorin may modulate NMDA glutamate receptor signaling between Schwann cells, or between adjacent membranes of a single Schwann cell.

In one embodiment, it is contemplated that tramdorins may be to a patient suffering at least one symptom of neurogenic and/or neuropathic pain. In another embodiment, said administration is by direct injection. Once again, however, Applicants note that a the present invention is not limited by tramdorins' precise mechanism of action or any specific mode of administration.

IX. Tramdorin Localization Using Antiserum

To characterize tramdorin1, an antiserum was raised against a sequence near the N-terminus that was divergent among the tramdorin gene family (e.g. antisera to a synthetic peptide: ESAKKLQSQDPSPANGTSC (SEQ ID NO: 74), containing amino acids 22-39 near the N-terminus of tramdorin1, as described in the section above.

Figure 26:
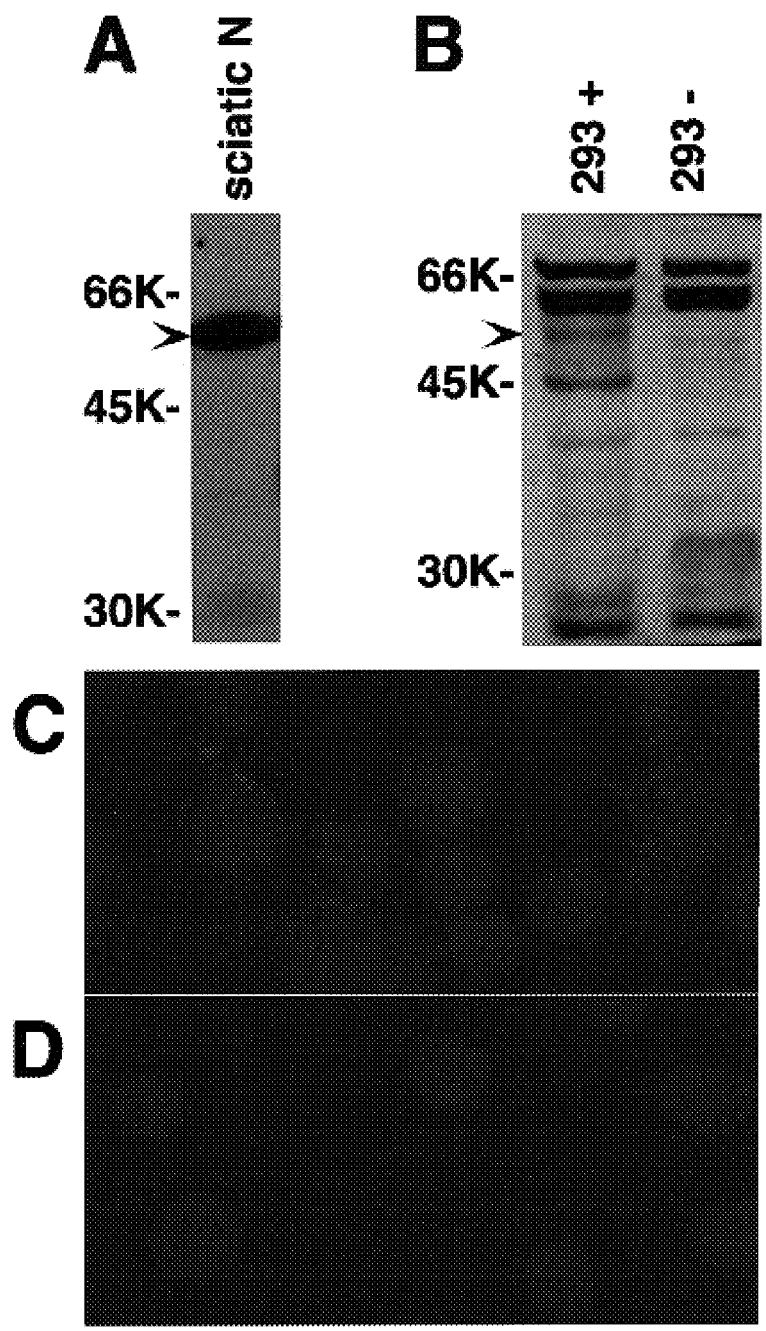
FIGS. 26A-D depict immunoblot analysis of tramdorin1. Specifically this figure presents a Western blot analysis of anti-tramdorin1 antiserum. 100 μg of lysates from (see, FIG. 26A) adult rat sciatic nerve and (see, FIG. 26B) 293 cells transfected with tramdorin1 expression vector (+), and untransfected 293 cells (−) were used for western blot analysis of the tramdorin1 antiserum (diluted 1:1000); the blots were developed with chemiluminescence. See, FIG. 26C and FIGS. 26D. Micrographs showing transfected (FIG. 26C) or untransfected (FIG. 26D) 293 cells viewed by immunofluorescence using the anti-tramdorin1 antiserum. Nuclei were visualized using DAPI.
Figure 27:
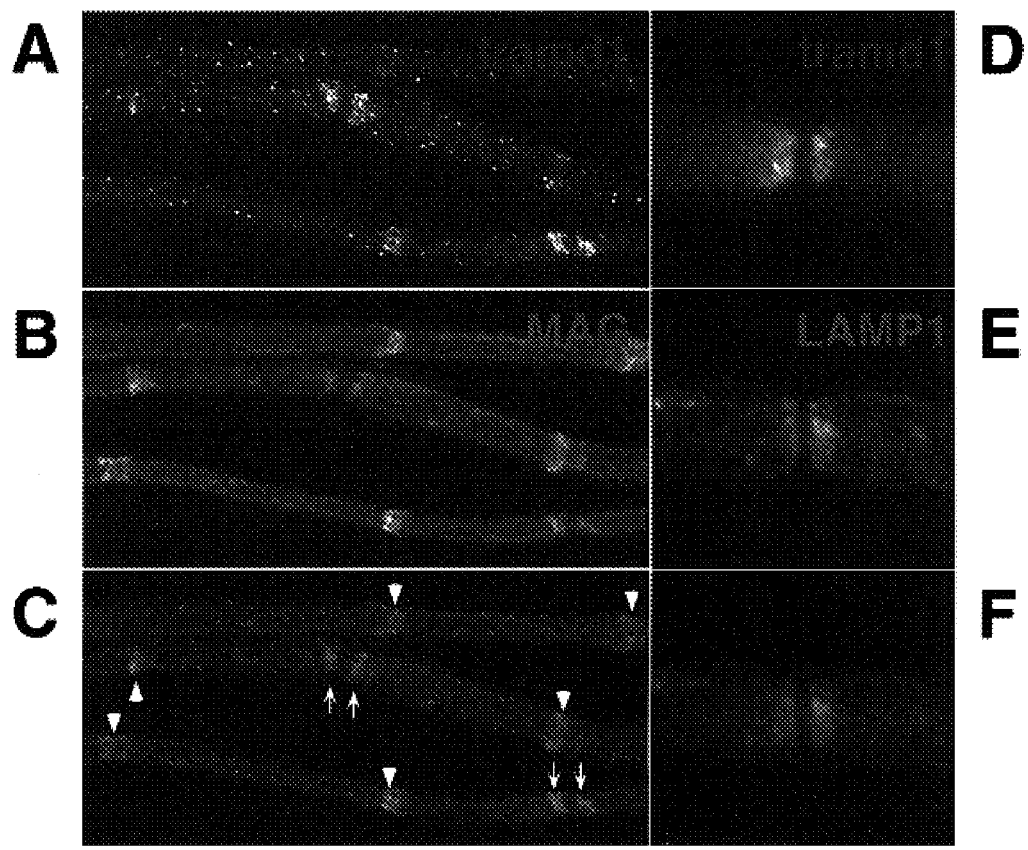
FIGS. 27A-F depicts localization of tramdorin1 in myelinating Schwann cells. These are images of unfixed teased fibers from adult rat sciatic nerve, double-labeled with a rabbit tramdorin1 antiserum (see, FIGS. 27A and 27D; TRITC) and a mouse monoclonal antibody against MAG (see, FIG. 27B; FITC) or LAMP1 (see, FIG. 27E; FITC). Tramdorin-immunoreactivity is found at paranodes (arrows) and incisures (arrowheads), colocalizing with MAG (FIGS. 27A-C), and in puncta along the outer surface. At paranodes (FIGS. 27D-F), tramdorin 1-immunostaining does not co-localize with that of LAMP1, a lysosomal marker.

In immunoblots of adult rat sciatic nerve, the antiserum binds to a single band close to the predicted molecular weight of unglycosylated tramdorin1 (panel A of FIG. 29). A band of similar molecular weight is observed on immunoblots of cells transfected with full-length mouse tramdorin1 cDNA (panel B of FIG. 29). Transfected cells were stained with the anti-tramdorin1 antiserum, whereas parental cells were unstained (panel C of FIG. 26). To localize tramdorin1, unfixed myelinated fibers from rat sciatic nerves were labeled with this antiserum. Tramdorin1 was localized in incisures and the paranodes, as shown by co-labeling with a monoclonal antibody against myelin associated glycoprotein (MAG; panels A-C of FIG. 27). To determine if tramdorin1, like tramdorin3/LYAAT-1, is associated with lysosomes, teased fibers were double-labeled for tramdorin1 and LAMP1, a lysosomal marker. Panels D-F of FIG. 27 shows that tramdorin1 and LAMP1 are found in paranodes, but do not co-localize. While it is not intended that the present invention be limited to any particular motif of localization or a particular mechanism of action, this immunostaining suggest that tramdorin1 is localized to non-compact myelin, but is not a component of lysosomes.

Again, while it is not intended the present invention be limited to any specific mechanism, Tramdorin1/mPAT2 has been shown to function as a proton-dependent transporter of small amino acid. See, Boll, M., Foltz, M., Rubio-Aliaga, I., Kottra, G., and Daniel, H. (2002). Functional Characterization of Two Novel Mammalian Electrogenic Proton-dependent Amino Acid Cotransporters. J Biol Chem 277, 22966-73. It is related to yeast vacuolar and rat lysosomal amino acid transport proteins, but unlike tramdorin3/LYAAT-1, tramdorin1 does not appear to be a lysosomal protein. Tramdorin1 lacks a putative lysosomal targeting motif (an acidic residue located in the C-terminus, −4 to −6 relative to a dileucine, (LL(I,M,V) that is present in tramd3/LYAAT-1. See, Sandoval, I. V., Martinez-Arca, S., Valdueza, J., Palacios, S., and Holman, G. D. (2000). Distinct reading of different structural determinants modulates the dileucine-mediated transport steps of the lysosomal membrane protein LIMPII and the insulin-sensitive glucose transporter GLUT4. J Biol Chem 275, 39874-85. Tramdorin1/mPAT2 shows strong specificity for glycine, L-alanine and L-proline, with greatest inward currents generated by glycine (See, Boll supra). This restricted substrate specificity and localization suggest that glycine and glycine transport have a role in myelinating Schwann cells and modulating physiologies of the nervous system.

EXPERIMENTAL

The following examples serve to illustrate certain preferred embodiments and aspects of the present invention and are not to be construed as limiting the scope thereof.

In the experimental disclosure which follows, the following abbreviations apply: eq (equivalents); M (Molar); μM (micromolar); N (Normal); mol (moles); mmol (millimoles); μmol (micromoles); nmol (nanomoles); g (grams); mg (milligrams); μg (micrograms); L (liters); ml (milliliters); μl (microliters); cm (centimeters); mm (millimeters); μm (micrometers); nm (nanometers); ° C. (degrees Centigrade); RDA (representational difference analysis); nts (nucleotides).

Example 1

This example describes the identification of the cDNA for mouse tramdorin 1. RDA on sciatic nerve from Oct-6 (−/−) and (+/+) sciatic nerves was performed as described (Bermingham et al., *J Neurosci Res* 63:516 (2001); Erkman et al., *Eur J Pharmacol* 393:97 (2000)). The RDA procedure was performed essentially as described elsewhere (Hubank et al., *Nucleic Acids Res* 22:5640 (1994); Lisitsyn et al., *Science* 259:946 (1995); Adman et al., *Biochem J* 323:113 (1997)), with the following modifications: Carrier mRNA (Bermingham et al., manuscript in preparation) was added to the total RNA for most experiments, prior to the isolation of poly-A+ RNA and subsequent cDNA synthesis. cDNAs were digested with DpnII, which cleaves at the recognition site GATC; because the four base 5' overhang that results from its cleavage is identical to that generated by BglII, the J, N, and R oligonucleotides that were designed by (Lisitsyn et al., *Methods Enzymol* 254:291 (1995)) for use on genomic RDA with BglII were used here to amplify Dpn-II generated fragments. The "N" adaptors were ligated to the Dpn-II ends. Those fragments with two appropriately spaced adaptors were amplified by two rounds of PCR. Typically 50-600 bp fragments were amplified. A small proportion of each of the drivers was digested with DpnII to remove the "N" adaptors, after which they were replaced with "R" adaptors. Each "tester" DNA was mixed with an excess of driver that was derived from the other source, denatured, and permitted to anneal. The reannealed DNA was amplified by PCR, digested with mung bean nuclease (New England Biolabs, Beverly, Mass.) to remove the single strands that result from priming at only one end of a template, then amplified again by PCR. DNA was digested with DpnII to remove the "R" adaptors, after which they were replaced with "J" adaptors. This material was used as the tester for a second round of subtraction, after mixing with an excess of driver. The products of the second round of subtraction were subjected to two rounds of PCR amplification to produce the second difference products, DP2. The linkers were removed from the DP2 DNA, after which it was cloned. DpnII fragments were ligated into the BamHI site of pBKSII+ (Stratagene, La Jolla, Calif.). Ligations were transfected into DH5α (Gibco-BRL, Grand Island, N.Y.).

Because Oct-6 is transiently expressed in sciatic nerve, these experiments were carried out on nerves that were isolated at P0 (day of birth), at or near the peak of Oct-6 expression. Six RDA cDNA clones corresponded to genes that are downregulated in the absence of Oct-6, and therefore are putatively activated by Oct-6 in sciatic nerve (Bermingham et al., manuscript in preparation). The differential abundance of these clones in cDNA from wild-type and Oct-6 mutant sciatic nerves was confirmed by hybridization to Southern blots of PCR-amplified cDNA ("Snorthern blots"). These blots are reliable indicators of differential expression (Bermingham et al., *J Neurosci Res* 63:516 (2001); Bermingham et al., manuscript in preparation). As described in Bermingham et al., *J Neurosci Res* 63:516 (2001), Snorthern blots use cDNA that was amplified by PCR for use as driver in the RDA experiments described above. PCR reactions were optimized to ensure that amplification was exponential, and parallel PCR reactions were pooled to minimize variation from individual samples and to obtain sufficient material. Driver DNA (0.5 or 1 μg) was electrophoresed through 3% NuSieve 3:1 agarose (FMC) or 4% acrylamide gels, then transferred by conventional Southern blotting or electroblotting onto Hybond N+ membranes (Amersham, Arlington Heights, Ill.).

The results for one clone, 125, is shown in FIG. 1A. RDA clone JBSN125 contains a cDNA fragment that corresponds to a putative Oct-6 regulated gene The panels show Southern blots of PCR-amplified cDNA ("Snorthern blots") from Oct-6 (+/+) (wild-type) and Oct-6 (−/−) (mutant) sciatic nerves. The left-hand panel shows a Snorthern blot that has been hybridized to RDA clone JBSN125; it indicates that one of two inserts in this clone corresponds to a gene that requires Oct-6, directly or indirectly, for normal activation. The larger insert is not differentially expressed, and serves as an internal control. A subclone that contains only the smaller insert, JBSN 125-10, also is differentially expressed (data not shown). The center and right panels are control blots that have been hybridized with JBSN11, a lacZ-containing clone, and Oct-6. No putative Oct-6 repressed genes were isolated, except for LacZ and Neo, which are expressed in the knockout mice. As expected, Oct-6 is expressed only in Oct-6 (+/+) sciatic nerves. The sizes of the fragments on the blots reflect the presence of 24 bp linkers on the ends of the fragments. The differentially expressed subclone, JBSN 125-10, was used to isolate additional sequence for this gene.

Figure 1B:
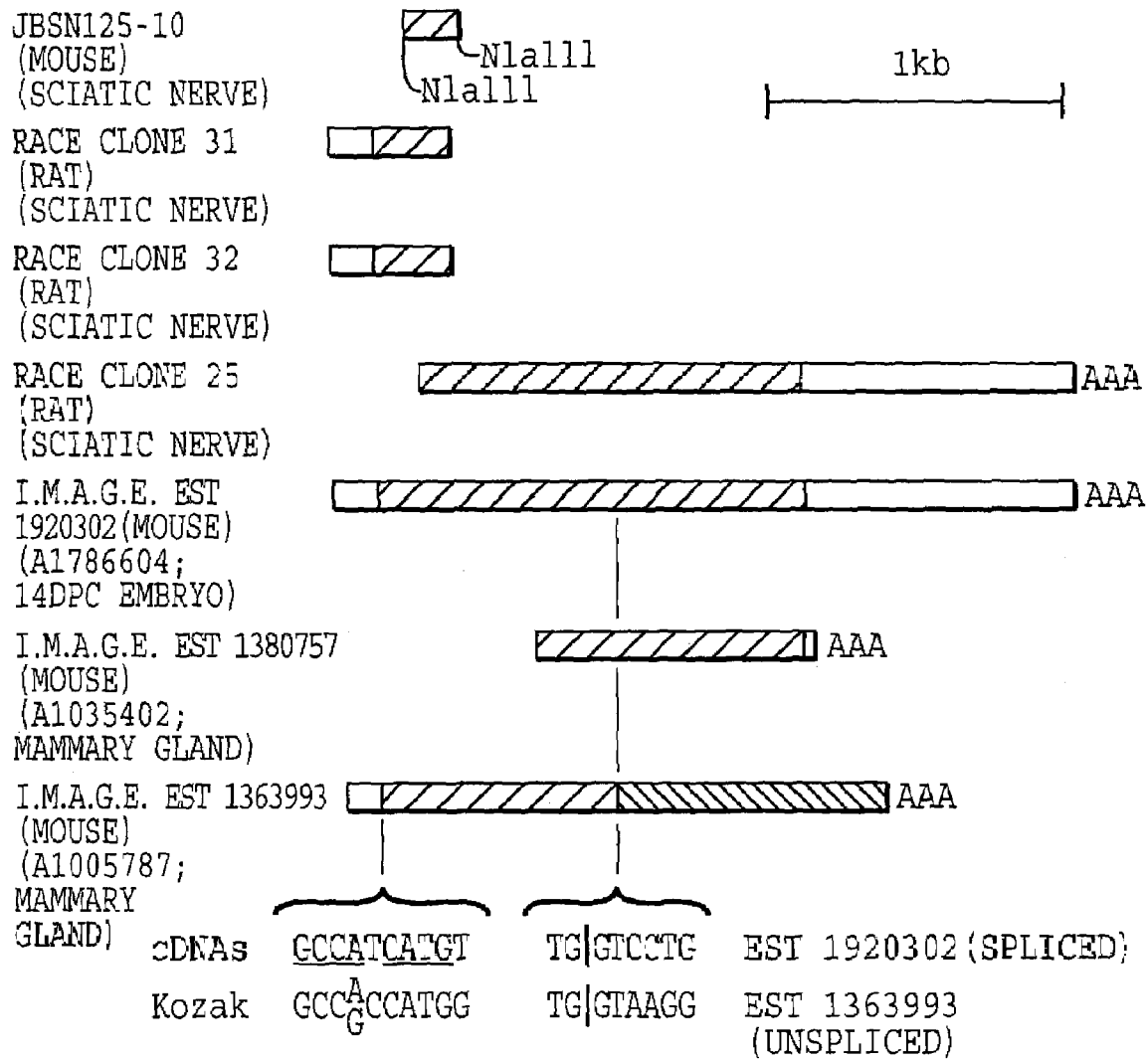

Mouse cDNAs that correspond to clone 125-10 were isolated by obtaining and sequencing three homologous EST clones 1920302 (AI786604), 1380757 (AI035402), and 1363993 (AI005767) (FIG. 1B). FIG. 1B shows cDNAs that correspond to RDA clone JBSN125-10. Seven cDNA fragments, from two species (rat and mouse) are shown; they include the RDA fragment JBSN125-10, two independent, nonidentical 5' RACE rat cDNAs, a 3' RACE rat cDNA, and three mouse EST cDNAs. Of these, the 2.45 kb mouse EST cDNA 1920302 (SEQ ID NO:13) appears to include the entire open reading frame, which is depicted in black. The organism and tissue of origin of each cDNA fragment is listed. The open reading frame commences with an ATG initiation codon that matches the Kozak consensus (Kozak, *Nucleic Acids Res* 15:8125 (1987)). EST clone 1380757 (SEQ ID NO:50) contains a polyA tract just following the stop codon; because no consensus polyadenylation signal exists in the cDNA near this site, this clone probably represents an artifactual polyadenylation event. EST cDNA clones 1920302 (SEQ ID NO:13) and 1363993 (SEQ ID NO:43) diverge at the 5' splice site at the 3' end of exon 7; comparison with genomic sequences indicates that EST cDNA 1363993 is unspliced. The intron-derived reading frame contains only three amino acids before a stop codon. Mouse EST 1363993 (AI005767) (SEQ ID NO:43) thus appears to correspond to a partially spliced transcript.

The full-length mouse cDNA contains a 1.4 kb open reading frame (FIGS. 2A-D) that encodes a protein of 52 kd. The mouse cDNA and the putative protein that it encodes do not match any genes in the GenBank non-redundant database, or the SwissProt database. Therefore, this cDNA is derived from a novel gene. FIGS. 2A-D also shows a putative rat tramdorin 1 cDNA, derived from 5' and 3' RACE sequences (see Example 2). FIGS. 2A-D shows the translated proteins; the mouse cDNA appears to encode a 478 amino acid protein, while the corresponding rat protein is 481 amino acids. Exon boundaries are superimposed on the mouse cDNA sequence. The boundaries of exons 8, 9 and 10 are defined by comparison to Ensembl mouse genomic sequence files, while the remainder are defined by sequencing of 129 mouse genomic DNA. The polyA tract of EST cDNA 1380757 (SEQ ID NO:50) commences at the A at position 1603. A putative polyadenylation site is shown in bold; such AGUAAA (SEQ ID NO:51) polyadenylation signals are processed in vitro at roughly 30% of the efficiency of the canonical AAUAAA (SEQ ID NO:52) signal (Sheets et al., *Nucleic Acids Res* 18:5799 (1990)). The NlaIII restriction sites (CATG) that flank RDA clone 125-10 are shown in italics.

Example 2

This example shows the identification of a rat tramdorin 1 cDNA.

Rat cDNAs that correspond to clone 125-10 were isolated by 5' and 3' RACE (rapid isolation of cDNA ends (Frohman, *Methods Enzymol* 218:340 (1993); Frohman, PCR Methods Appl 4:S40 (1994)). RNA was isolated from sciatic nerves taken from one to two day old rat pups. First strand cDNA was synthesized using Superscript II reverse transcriptase (Gibco-BRL). RACE was performed using a kit from Clontech, according to the manufacturer's instructions. The 3' rat tramd1 RACE primer has the following sequence:

5'GACTTCCCCTGGCTGTGAAGAATGCGGGC 3' (SEQ ID NO:53)

and the 5' rat tramd1 RACE primer has the following sequence:

5'TcAGTCTGTGACAGAAGCGCTGGGCACATCtG 3' (SEQ ID NO:54)

The lower case nucleotides represent mismatches between the 5' RACE sequence and the final rat sequence. The final rat sequence has G's replacing the lower case letters in the 5' primer.

The 5' and 3' rat RACE fragments combined define a 2.5 kb cDNA (SEQ ID NO:55). The full-length rat cDNA contains a 1.4 kb open reading frame (SEQ ID NO:6) (FIGS. 2A-D) that encodes a protein of 52 kd (SEQ ID NO:22). The rat cDNA and the protein that it encodes does not match any genes in the GenBank non-redundant database, or the SwissProt database. Therefore, this cDNA is derived from a novel gene. The sequence of a rat tramdorin1 cDNA, derived from 5' and 3' RACE sequences is shown in FIGS. 2A-D (SEQ ID NO:6), as is the translated protein. The rat protein is 481 amino acids.

Example 3

This example describes structural predictions for the protein encoded by mouse tramdorin 1 and related tramdorins in humans.

Figure 3B:
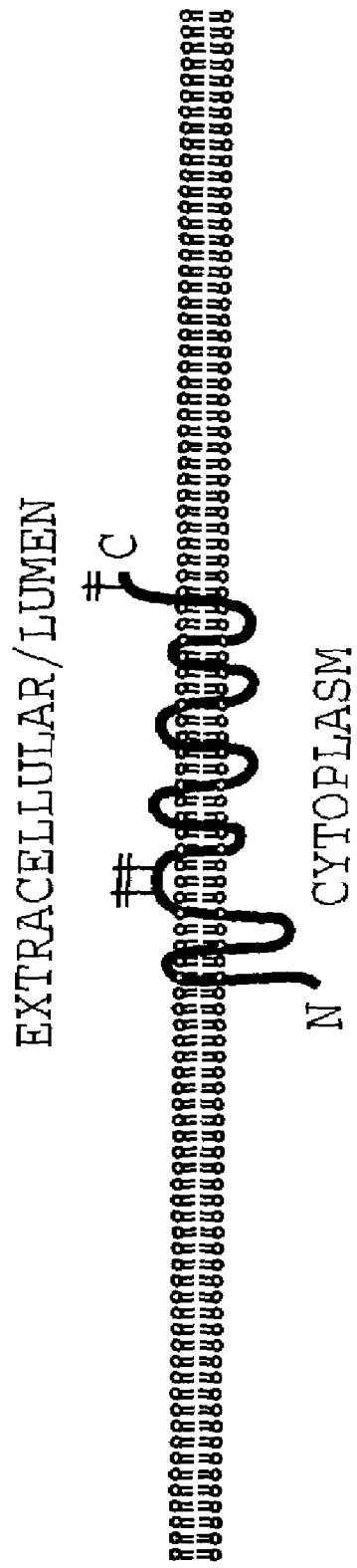

The protein encoded by mouse cDNA 1920302 (SEQ ID NO:13) was predicted by several protein structure prediction programs to encode a transmembrane protein. These programs use aspects of protein structure such as hydropathy and charge distributions and/or utilize different algorithms to arrive at their predictions. Although all the programs used predicted the protein would be a polytopic transmembrane protein, they differed in the number of transmembrane domains predicted. PHDHtm (Rost et al., *Protein Sci* 4:521 (1995)) and TM finder (Deber et al., *Protein Sci* 10:212 (2001)) predicted 8 transmembrane domains (FIG. 3A and data not shown). PRED-TMR (Pasquier et al., *Protein Eng* 12:381 (1999)) predicted the presence of 10 putative transmembrane domains, and an Argos hydropathy plot (Argos et al., *Eur J Biochem* 128:565 (1982)) predicted 10 hydrophobic domains with a possible 11$^{th}$ (data not shown). Memsat2 (PSIPRED; McGuffin et al., *Bioinformatics* 16:404 (2000)), and TMHMM (Sonnhammer et al., *Proc Int Conf Intell Syst Mol Biol* 6:175 (1998)) predict that the protein contains 11 transmembrane helices with the N-terminus facing the cytoplasm (FIG. 3B). Regardless of the differing predictions about the number of transmembrane domains, or their topology, this protein appears to contain multiple transmembrane helices. Therefore we have named the putative gene product tramdorin, for transmembrane domain rich protein. Tramdorin has been assigned the human and mouse gene symbol tramd1.

The putative amino acid sequence encoded by the putative full length EST cDNA 1920302 (SEQ ID NO:13) is shown in FIG. 3A. The amino acid sequence of EST cDNA 1920302 (SEQ ID NO:14) was analyzed using the transmembrane domain prediction programs PHDHtm (Rost et al., *Protein Sci* 4:521 (1995)), Memsat2 (McGuffin et al., *Bioinformatics* 16:404 (2000)), and TMHMM (Sonnhammer et al., *Proc Int Conf Intell Syst Mol Biol* 6:175 (1998)). 11 putative transmembrane domains are numbered. Transmembrane domains predicted by PHDHtm and TMHMM are marked with Capital T's. For Memsat2, transmembrane domains are marked as follows: O: outside transmembrane helix cap; X: central transmembrane helix segment; I: inside transmembrane helix cap. For both Memsat2 and TMHMM, predicted cytoplasmic domains are marked by "+", while non-cytoplasmic domains are marked by "–". The partially spliced EST cDNA 1363993 (SEQ ID NO:43) is truncated following putative transmembrane domain #6. Three consensus glycosylation sites within the protein sequence are shown in bold. FIG. 3B shows a diagram depicting the predicted topology of tramdorin1 with 11 transmembrane domains, as predicted by Memsat2 and TMHMM. The three extracellular/lumenal glycosylation sites are marked with branched structures. While it is not intended that the present invention be limited to any particular level of gylcosylation (if any) the electrophoretic mobility of tramdorin suggests that it is not glycosylated extensively. Moreover, glycosylation is shown in black at only one site, in accordance with the observation that in transmembrane domain proteins with multiple glycosylation sites, only one is typically used (Landolt-Marticorena et al., *Biochem J* 302:253 (1994)); the others are shown in gray.

While a precise understanding of the structure of tramdorin is not required for the practice of the present invention, the following considerations suggest that tramd proteins consist of 11 transmembrane domains, with the N-terminus facing the cytoplasm. However, the invention is not to be limited to such a structural prediction of tramdorin proteins. First, those programs that predicted 11 transmembrane domain helices more accurately predicted the number and topology of the transmembrane helices of a set of transmembrane proteins of known structure (Tusnady et al., *J Chem Inf Comput Sci* 41:364 2001). Therefore those programs also may be better at predicting the structure of unknown proteins. Although PHDHtm, which predicted 8 transmembrane domains, has been shown to be up to 90% accurate in predicting transmembrane helices, the predicted helices often were too long. Consistent with this observation, the first, third and seventh transmembrane domains predicted by PHDHtm are much longer than typical transmembrane domains (23-30 amino acids; reviewed in (von Heijne, *Prog Biophys Mol Biol* 66:113 (1996)), and are predicted to be two transmembrane domains by memsat2 and TMHMM. Second, analysis of human tramd1, -2, and -3 using Memsat2 and TMHMM produced 11 transmembrane predictions similar to those shown for mouse tramd1 in FIGS. 3A-B, except that TMHMM did not predict the first transmembrane domain for human tramdorin 1. Third, if the protein were to possess 10 transmembrane domains, analysis of charged amino acids flanking the first putative transmembrane domain (as predicted by either PHDHtm or PRED-TMR) suggests that the N-terminus will be outside the cytoplasm (Hartmann et al., *PNAS USA* 86:5786 (1989)). Such a topology could arise from cleavage of an N-terminal signal sequence. However, a signal sequence prediction program (Nielsen et al., *Protein Eng* 10:1 (1997)) indicates that the protein does not appear to contain a cleaved N-terminal signal sequence. Fourth, membrane proteins are glycosylated only on their extracytoplamic faces, and the distribution of glycosylation consensus sites (NX$^{S}/_{T}$, [Asn Xaa Ser/Thr] (SEQ ID NO:56) wherein X [Xaa] is any amino acid except proline) supports the Memsat2 and TMHMM topology. The mouse tramd1 protein sequence contains five putative glycosylation sites. Of these, an N-terminal NGT [Asn Gly Thr] sequence is not conserved in human, and an NIS [Asn Ile Ser] sequence is buried in predicted transmembrane helix 5. The three conserved, non-transmembrane domain consensus glycosylation sites are predicted to be extracytoplasmic in the structures predicted by Memsat2 and TMHMM. Thus the preponderance of evidence from protein structure prediction programs suggests that the protein contains 11 transmembrane domains, with the N-terminus facing the cytoplasm (FIG. 3B).

However, as noted above, the invention is not limited to any particular tramdorin structure, and several considerations suggest alternative structures for tramdorins. The 11 transmembrane model for tramdorin structure. Proteins with 11 transmembrane domains are very rare (Jones, *FEBS Lett* 423:281 (1998)). Furthermore, the closest known relatives of tramdorins, the vesicular GABA transporters, are thought to consist of 10 transmembrane domains; they correspond to predicted transmembrane domains 2-11 of tramdorin1. For the *C. elegans* vesicular GABA transporter AF031935.1, the memsat2 program predicted 10 transmembrane domains, but the orientation in the membrane was opposite that shown in (McIntire et al., *Nature* 389:870 (1997)), while TMHMM predicted 9 transmembrane domains (data not shown). These observations raise the possibility that current transmembrane domain structure prediction programs may have difficulty predicting correctly the structure of vesicular GABA transporters, and may have difficulty with tramdorins as well. Thus, the theoretical prediction that tramdorins consist of 11 transmembrane domain proteins with cytoplasmic N-termini should not be considered limiting for the purposes of the present invention cDNAs that encode truncated tramdorin proteins have been identified for both human and mouse tramd1, and for tramd3. In the case of mouse and human tramd1, the cDNAs that encode truncated proteins arise from the failure to splice out the intron that follows exon 7. This intron is unusual in that it possesses 3 regions of homology between mouse and human, clustered at its 5' end (SEQ ID NO:7). While not to be limited to any particular mechanism, if these conserved regions of homology are related to the splicing of exon 7, they may indicate a biological role for the truncated proteins. Such proteins would contain the first six putative transmembrane domains.

Example 4

Figure 4:
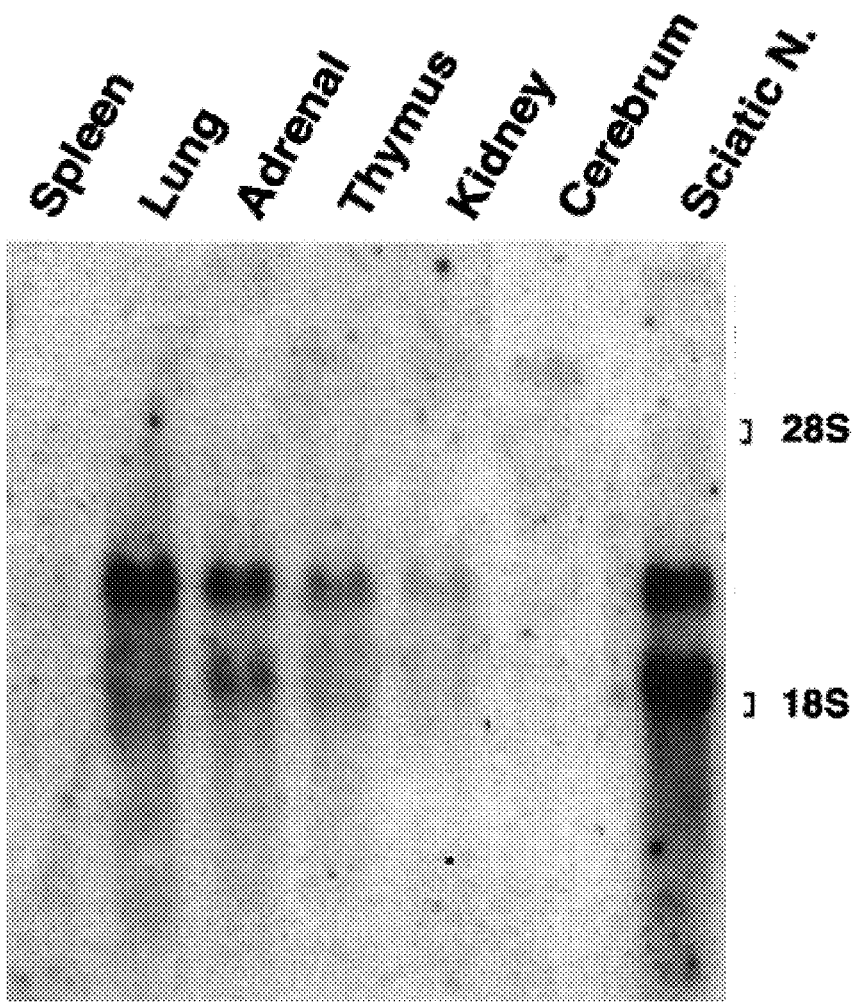
FIG. 4 shows a Northern blot depicting the tissue-specific expression of mouse tramdorin 1.

This example is directed to the expression pattern of tramdorin 1 in the mouse. To determine the size of tramdorin mRNA(s) and to determine if tramdorin expression is restricted to sciatic nerve, a northern blot with RNAs from adult mouse sciatic nerve and other tissues was hybridized to a radiolabelled probe synthesized from tramdorin cDNA 1920302 (SEQ ID NO:13) (See, FIG. 4). Specifically, Each lane contains an equal amount (10 µg) of total RNA isolated from the indicated mouse tissues. The blot was successively hybridized to a radiolabeled probe corresponding to tramdorin1, and exposed to film for 14 days after the hybridization. The sizes of the transcripts are estimated according to the sizes of 28S and 18S rRNAs (4712 nt and 1869 nt, respectively; (Hassouna et al., 1984; Raynal et al., 1984).

The probe hybridized strongly to two distinct transcript classes in sciatic nerve, of approximately 2 kb and 2.8 kb in size. Of these, hybridization was strongest to the 2 kb transcripts. The sizes of the transcripts were based on the sizes of 28S and 18S rRNAs (4712 nt and 1869 nt, respectively; (Hassouna et al., *Nucleic Acids Res* 12:3563 (1984); Raynal et al., *FEBS Lett* 167:263 (1984)). No expression was observed in spleen, and only a very faint band was seen at >6.5 kb in cerebrum, indicating that tramdorin 1 is not ubiquitously expressed. The 2.8 kb species is the most prominent tramdorin 1 message in lung, adrenal gland and thymus. This result indicates that EST cDNA 1920302 (SEQ ID NO:13) defines a nearly full length tramd1 message, and must correspond to the larger transcript class, because it is approximately 2.45 kb, excluding the polyA tail. Therefore tramdorin1 expression is neither ubiquitous, nor restricted to sciatic nerve. In contrast, a similar northern using rat tissue did not show hybridization to lung and thymus (data not shown), suggesting either variation in tramdorin1 expression among species, or cross-hybridization to related sequences.

Whether the expression of tramd1 in sciatic nerve is modulated by nerve injury was of interest. If so, its pattern of expression would determine if the genes are expressed in myelinating or non-myelinating/immature Schwann cells. Axotomy leads to a sharp decline in the steady state mRNA levels for myelin-related genes, and an increase in the expression of genes associated with immature Schwann cells. Subsequently, in crushed nerves, Schwann cells re-express myelin-related genes in response to contact with regenerating axons (reviewed in Poduslo, "Regulation of myelin gene expression in the peripheral nervous system." In Dyck, P. J. et al. (eds), Peripheral Neuropathy, W.B. Saunders Co., Philadelphia, pp. 282-289 (1993)).

A northern blot of RNA from sciatic nerves collected at various times following crush or transection injury was hybridized with a mouse tramd1 probe (FIG. 5). It should be noted that the mouse tramd1 probe also hybridized with a northern blot of RNA from rat nerve tissue. Adult Sprague Dawley rats were anesthetized with 50 mg/kg pentobarbitol i.p., and the sciatic nerves were exposed at the obturator tendon. To prevent axonal regeneration, nerves were doubly ligated and transected between the ligatures. Nerves were crushed by compression with flattened forceps twice, each time for 10 seconds. Animals were allowed to survive for various periods of time prior to sacrifice by $CO_2$ inhalation. For RNA extraction, several millimeters of nerve adjacent to the lesion site were trimmed off, and the distal nerve-stumps were frozen in liquid nitrogen. Where indicated, the distal stumps of crushed nerves were subdivided into proximal and distal segments of equal lengths. Unlesioned nerves were taken from animals of various ages. Total RNA was isolated from the sciatic nerves by $CsCl_2$ gradient centrifugation (Chirgwin et al., *Biochem* 18:5294 (1979)). Equal samples (10 µg) of RNA were electrophoresed in 1% agarose, 2.2 M formaldehyde gels, transferred to nylon membranes in 6×SSC, and UV cross-linked (0.12 joules). Blots were prehybridized, hybridized, and washed using standard techniques (Sambrook et al., *Molecular Cloning: a Laboratory manual*. Cold Spring Harbor Laboratory, Cold Spring Harbor, N.Y. [1989] pp. 31). cDNA probes were $^{32}P$ labeled with specific activities of $2-5\times10^9$ cpm/µg, prepared by primer extension with random hexamers using the Prim-a-gene kit (Promega) according to the manufacturer's instructions.

Northern blots of RNA from segments of sciatic nerve distal to a transection injury (in which axons do not regenerate) and crush injury (in which axons regenerate and are remyelinated) were hybridized with probes for tramdorin, and Oct-6. The blots were hybridized also to probes for P0, p75 nerve growth factor receptor (NGFR) and GAPDH as controls. For the crushed nerves, RNA was made from two sciatic nerve segments, one immediately distal to the injury (P) and one more distal to the injury (D) (FIG. 5). Myelination occurs more slowly in the (D) segments because contact with regenerating axons is delayed.

Tramd1 expression is downregulated by transection injury, and remains low. Following a crush injury, tramd1 is downregulated, but subsequently it is reexpressed as axons regenerate and are remyelinated (FIG. 5). Therefore, the tramdorin1 gene encodes a myelin-related protein. Several genes that are required for normal myelination show this pattern of expression; these include Oct-6, P0, connexin32 and PMP-22. (Poduslo, "Regulation of myelin gene expression in the peripheral nervous system." In Dyck, P. J. et al. (eds), Peripheral Neuropathy, W.B. Saunders Co., Philadelphia, pp. 282-289 (1993); Scherer et al, *J Neurosci* 14:1930 (1994); Sohl et al., *Eur J Cell Biol* 69:267 (1996)). This result suggests that tramd1 may play an important role in the timely formation of peripheral myelin.

Example 5

This example describes experiments to determine the mouse chromosomal location of tramd1.

The mouse chromosomal location of Tramd1 was determined by interspecific backcross analysis using progeny derived from matings of [(C57BL/6J×*Mus spretus*)$F_1$× C57BL/6J] mice. This interspecific backcross mapping panel has been typed for over 3100 loci that are well distributed among all the autosomes as well as the X chromosome (Copeland et al., *Trends Genet* 7:113 (1991)). C57BL/6J and *M. spretus* DNAs were digested with several enzymes and analyzed by Southern blot hybridization for informative restriction fragment length polymorphisms (RFLPs) using a mouse cDNA probe specific for Tramd1. The 7.5 kb BglI *M. spretus* RFLP (see below) was used to follow the segregation of the Tramd1 locus in backcross mice. The mapping results indicated that Tramd1 is located in the proximal region of mouse chromosome 11 linked to Il13 and Hand1.

Figures 6A, 6B:
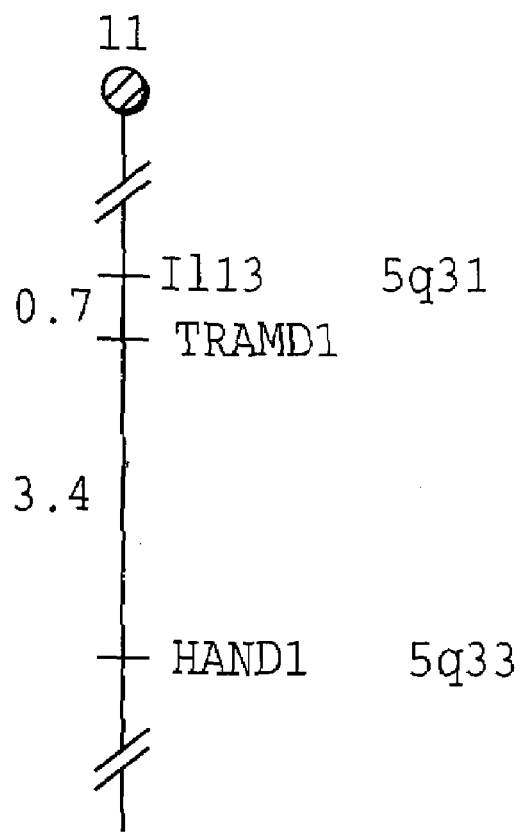
FIG. 6A and FIG. 6B summarize the mouse mapping results for tramdorin.

FIG. 6A shows a summary of the mapping results. Each column represents the chromosome identified in the backcross progeny that was inherited from the (C57BL/6J×*M. spretus*) F$_1$ parent. The shaded boxes represent the presence of a C57BL/6J allele and white boxes represent the presence of a *M. spretus* allele. The number of offspring inheriting each type of chromosome is listed at the bottom of each column. A partial chromosome 11 linkage map showing the location of Tramd1 in relation to linked genes is shown in FIG. 6B. Recombination distances between loci in centimorgans are shown to the left of the chromosome and the positions of loci in human chromosomes, where known, are shown to the right. References for the human map positions of loci cited in this study can be obtained from GDB (Genome Data Base), a computerized database of human linkage information maintained by The William H. Welch Medical Library of The Johns Hopkins University (Baltimore, Md.).

Although 136 mice were analyzed for every marker and are shown in the segregation analysis (FIG. 6A), up to 179 mice were typed for some pairs of markers. Each locus was analyzed in pairwise combinations for recombination frequencies using the additional data. The ratios of the total number of mice exhibiting recombinant chromosomes to the total number of mice analyzed for each pair of loci and the most likely gene order are: centromere-Il13-1/142-Tramd1-6/179-Hand1. The recombination frequencies (expressed as genetic distances in centiMorgans (cM)+the standard error) are-Il13-0.7+/−0.7-Tramd1-3.4+/−1.4-Hand1. This interspecific map of chromosome 11 has been compared with a composite mouse linkage map that reports the map location of many uncloned mouse mutations (provided from Mouse Genome Database, a computerized database maintained at The Jackson Laboratory, Bar Harbor, Me.). Tramd1 mapped in a region of the composite map that lacks mouse mutations with a phenotype that might be expected for an alteration in this locus (data not shown).

Interspecific backcross progeny were generated by mating (C57BL/6J×*M. spretus*)F$_1$ females and C57BL/6J males as described (Copeland et al., *Trends Genet* 7:113 (1991)). A total of 205 N$_2$ mice were used to map the Tramd1 locus, as described above. DNA isolation, restriction enzyme digestion, agarose gel electrophoresis, Southern blot transfer and hybridization were performed essentially as described (Jenkins et al., *J Virol* 43:26 (1982)). All blots were prepared with Hybond-N$^+$ nylon membrane (Amersham). The probe, a 503 bp BssHII/EcoRI fragment from the 3' UTR of cDNA 1920302, was labeled with [$\alpha^{32}$P] dCTP using a random primed labeling kit (Stratagene); washing was done to a final stringency of 0.5×SSCP, 0.1% SDS, 65° C. A fragment of 10.0 kb was detected in BglI digested C57BL/6J DNA and a fragment of 7.5 kb was detected in BglI digested *M. spretus* DNA. The presence or absence of the 7.5 kb BglI *M. spretus*-specific fragment was followed in backcross mice. A description of the probes and RFLPs for the loci linked to Tramd1 including Il13 and Hand1 has been reported previously (Cross et al., *Development* 121:2513 (1995); McKenzie et al., *J Immunol* 150:5436 (1993)). Recombination distances were calculated using Map Manager, version 2.6.5. Gene order was determined by minimizing the number of recombination events required to explain the allele distribution patterns.

The proximal region of mouse chromosome 11 in which tramd1 maps, is a region that is syntenic with human chromosome 5q. These results indicate that tramd1 is located on human 5q31-33, suggesting that the human homolog of Tramd1 will map to 5q31-33 as well. An autosomal recessive Charcot-Marie-Tooth Syndrome demyelinating neuropathy has been mapped to this region (Guilbot et al., *Ann NY Acad Sci* 883:56 (1999a); Guilbot et al., *Eur J Hum Genet* 7:849 (1999b); LeGuern et al., *Hum Mol Genet* 5:1685 (1996)), suggesting that tramdorin1 could be a candidate peripheral neuropathy disease gene.

Example 6

This example describes experiments directed at studying the human tramdorin gene. As a first step toward determining if tramdorin1 mutations are associated with human peripheral neuropathy, the human tramdorin gene was studied. Six human EST cDNAs that possess homology to mouse tramdorin1, I.M.A.G.E numbers 3184556 (BE501426), 1738130 (AI140615), 1837427 (AI208756), 1388139 (AA843982), and 2549054 (AI953890), as well as EST cDNA DKFZp434G1123 from the Deutsches Ressourcezentrum für Genomforschung GmbH (RZPD) were obtained and sequenced in their entirety. The sequences were aligned on human genomic DNA from the International Human Genome Sequencing Consortium (IHGSC) *Homo sapiens* chromosome 5 working draft sequence segment NT_006951.4 and Celera databases (Lander et al., *Nature* 409:860 (2001); Venter et al., *Science* 291:1304 (2001)). These cDNAs showed greatest homology to four discrete locations within 250 kb of chromosome 5q sequence (FIG. 7), confirming the mapping of tramdorin in mouse, but in addition, suggesting the existence of multiple tramdorin genes. These genes have been assigned the names tramd1, tramd2, tramd3, and tramdL.

Figure 7:
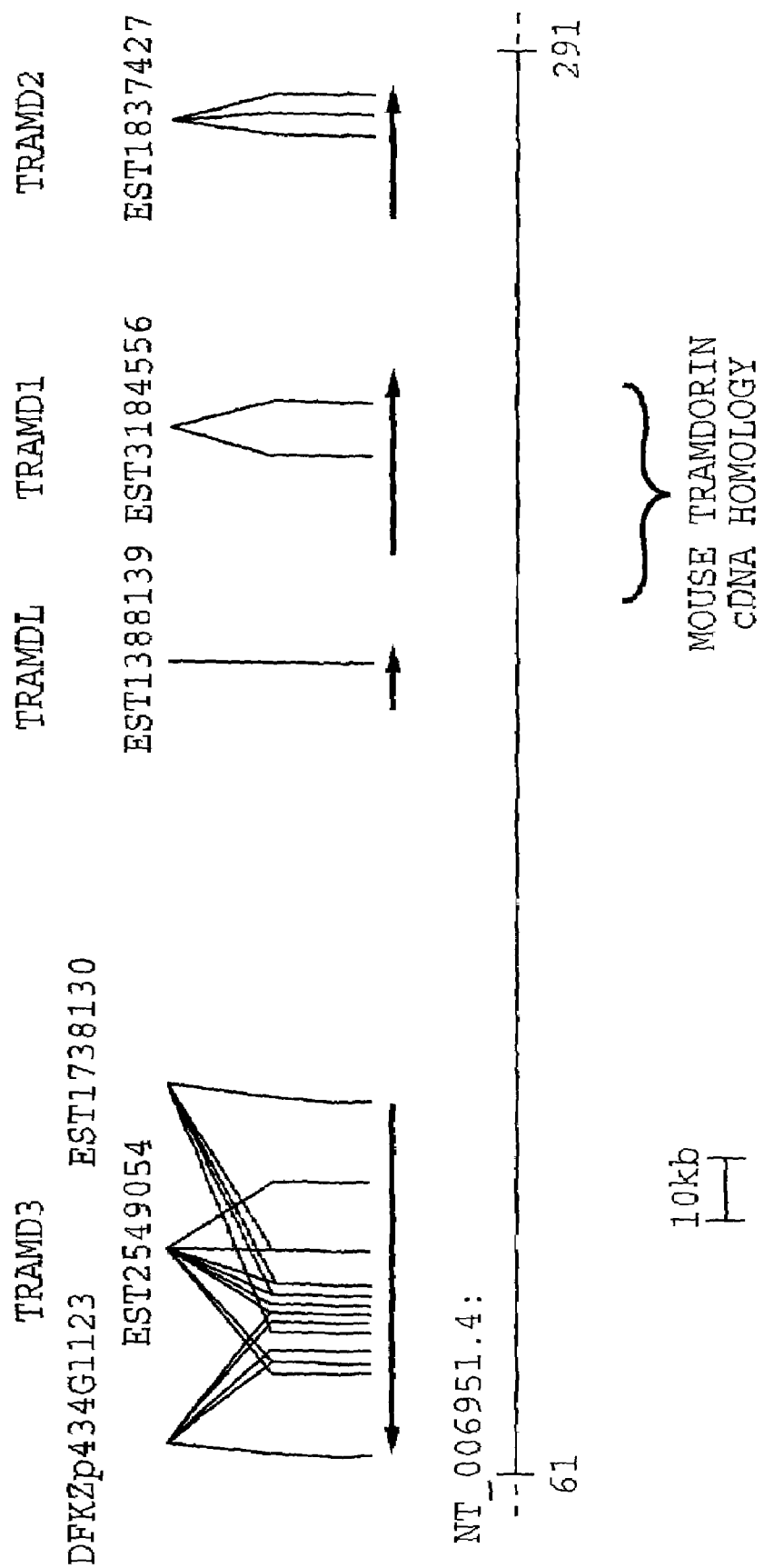
FIG. 7 shows the cluster of four human tramdorin genes defined by human tramdorin EST cDNAs.

In FIG. 7, the IHGSC sequences are shown; coordinates indicate kilobases of nucleotide sequence. The coordinates correspond to scaffold NT_006951.4 (1038-1290 kb). Human genomic sequences that are most homologous to mouse tramdorin 1 EST 1920302 reside between 70 and 102 kb. Therefore this region, and EST cDNA 3184556, are likely to represent the human homolog of mouse tramd1.

The human tramd1 gene has greatest homology to the original mouse tramd1 gene, and is flanked on its 3' end by tramd2, and on its 5' end by tramd3, which is transcribed in the opposite orientation to tramd1 and tramd2. Nested between tramd1 and tramd3 resides a tramdorin gene fragment, tramdL, in the same orientation as tramd1 and tramd2. It consists only of 3' tramdorin sequences, and is defined by a single EST cDNA, 1388139. All four putative genes are found on both the Celera and IHGSC sequences. The structures of individual tramdorin genes are shown in greater detail as described below.

Figure 8A:
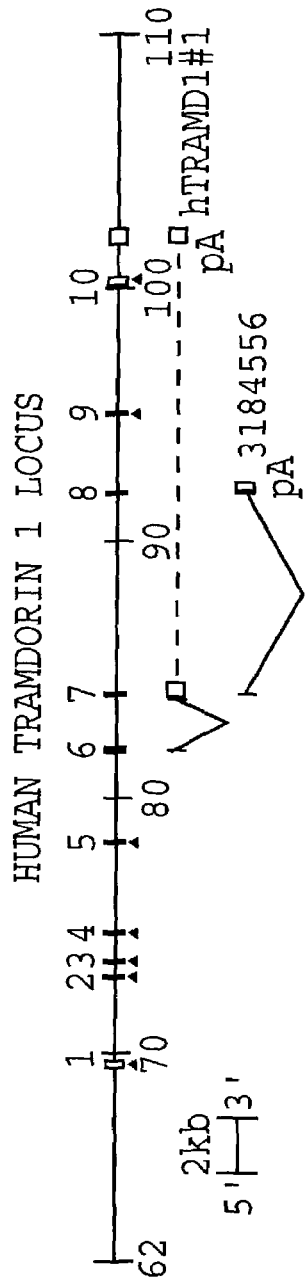
FIGS. 8A-D show the organization of the human tramdorin loci.
Figure 8B:
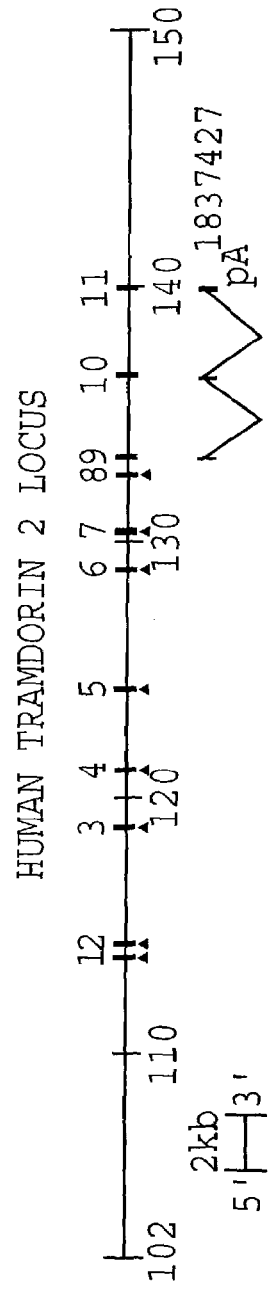
Figure 8C:
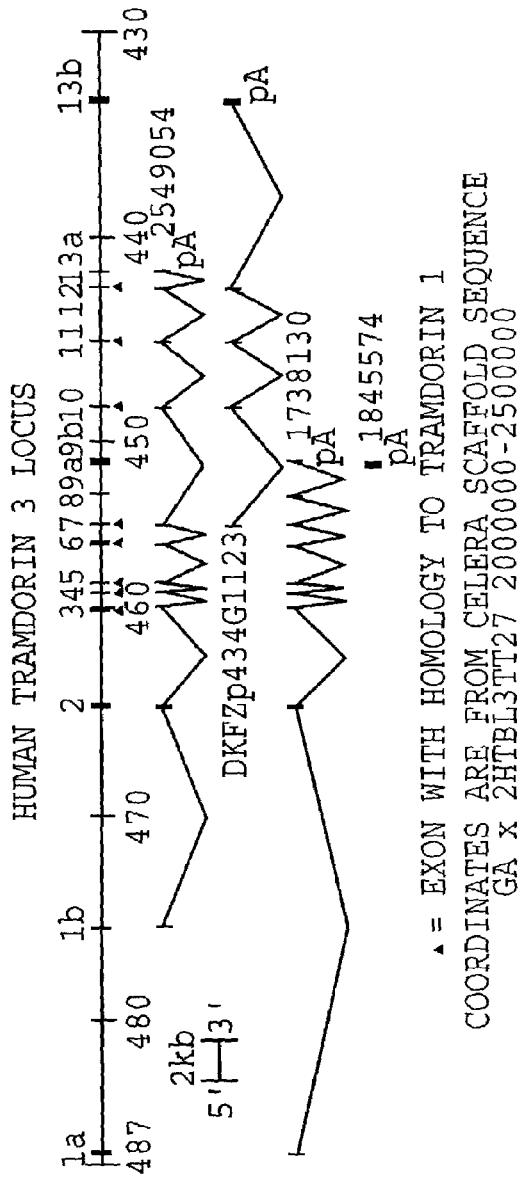
Figure 8D:
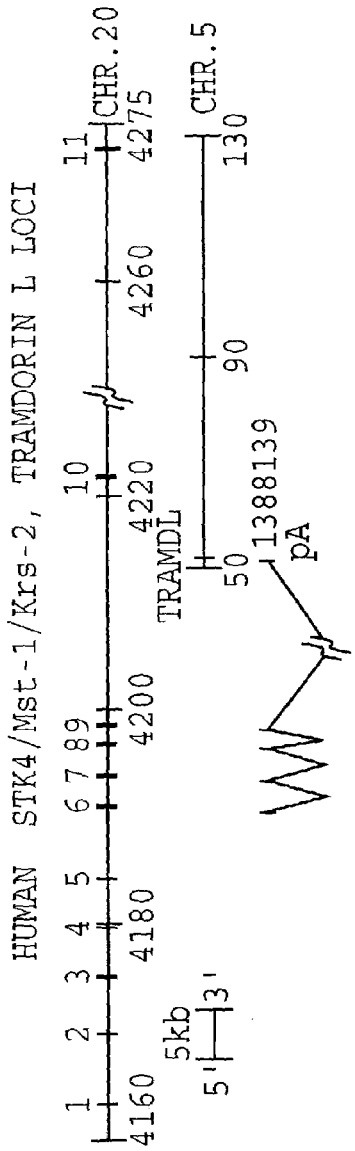

FIGS. 8A-D presents the organization of the human tramdorin loci. Sequences are from Celera human chromosome 5 scaffold sequence GA x2HTBL3TT27:2500000-3000000, except where specified. The human tramdorin 1 locus is shown in FIG. 8A. For cDNA htramd1#1, the dashed line represents an apparent non-splicing event has joined sequences that are located 15.7 kb apart in the genome. The human tramdorin 2 locus is depicted in FIG. 8B. Exons 1-7 were identified by homology to mouse tramd1 and/or human tramd3. Exons 8-10 were identified by homology to EST cDNA 1837427. The human tramdorin 3 locus is depicted in FIG. 8C. Sequence from Celera, except 1180 nt of ambiguous sequences between exons 3 and 4 were replaced with corresponding sequence from IHGSC sequence NT_006951.3, as represented by the break marks between exons 3 and 4. Three EST cDNAs contain sequences that are homologous to mouse tramd1; a fourth, 1845574, contains sequence that are homologous to the 3' end of EST cDNA 1738130. These cDNAs reveal that expression of the tramd3 gene generates multiple alternative transcripts. EST cDNA 1388139 contains sequences that correspond to both chromosome 5q and to the STK4/Mst-1/Krs-2 locus on chromosome 20 (FIG. 8D); the corresponding genomic regions are diagrammed. This EST encodes only one exon that is homologous to mouse tramdorin 1; on the chromosome 5q genomic sequence, no other exons with homology to mouse or human tramdorin genes was found within 20 kb of this exon. This locus does not encode a complete tramdorin protein, and therefore is called tramdorin L.

SEQ ID NO:26 shows sequence between nucleotides 50001 and 300000 of *Homo sapiens* chromosome 5 working draft sequence segment NT_006951.4. Each line of the figure has 100 nucleotides and each page has 7000 nucleotides. At the top of each page, the coordinates on sequence NT_006951.4 of the first nucleotide on that page is given. Known exons for tramdorin 1, tramdorin 2, tramdorin 3 and tramdL are shown in bold type and are also indicated in the right margin. These exons were identified by their inclusion in human cDNAs or are inferred by homology to the homologous mouse gene, or to paralogous human sequences. Initiation ATG and stop codons, and putative polyadenylation signal sites are shown in bold italic. Note that tramd3 is in the opposite orientation relative to the other tramd genes, and is shown in the antisense orientation. Note that a single nucleotide polymorphism (C-T) in exon 2 of human tramdorin 1 at position 222682 has been confirmed, resulting in a synonymous change of a leucine codon. Other polymorphisms may also exist.

The structure of the human tramdorin 1 gene was determined by identifying regions of homology between the mouse and human tramdorin genes using the Pustell homology program (Pustell et al., *Nucleic Acids Res* 10:4765 (1982b)). This program identified both putative exons (FIGS. 8A and 9) as well as other conserved sequences that may define transcriptional or splicing enhancers. Additional putative transcribed regions of the tramdorin 1 gene were defined by the EST cDNA 3184556 and a cDNA that was isolated from a human sciatic nerve cDNA library kindly provided by Drs. James Lupski and Cornelius Berkoel of Baylor University.

Exons 1-10 of the tramdorin 2 gene are depicted in FIGS. 8B and 9; they are defined by a single EST cDNA, 1837427, and by homology with tramdorins 1 and 3, and mouse tramdorin 2 cDNA. It should be noted that mouse tramd2 cDNA was used to identify the first exon. The known and inferred exons span 26 kb of genomic DNA.

The sequences of 4 alternatively spliced tramdorin 3 EST cDNAs were used to infer the structure of the tramdorin 3 gene (FIGS. 8C and 9). These cDNAs possess distinct sets of exons that together span 50 kb of genomic DNA. They demonstrate that expression of the tramd3 involves extensive alternative RNA processing to generate transcripts that encode tramd3 proteins with 3 distinct C termini. In addition, the distinct 5' ends of EST cDNAs 2549054 and 1738130 could indicate the presence of two tramd3 promoters.

Figure 25:
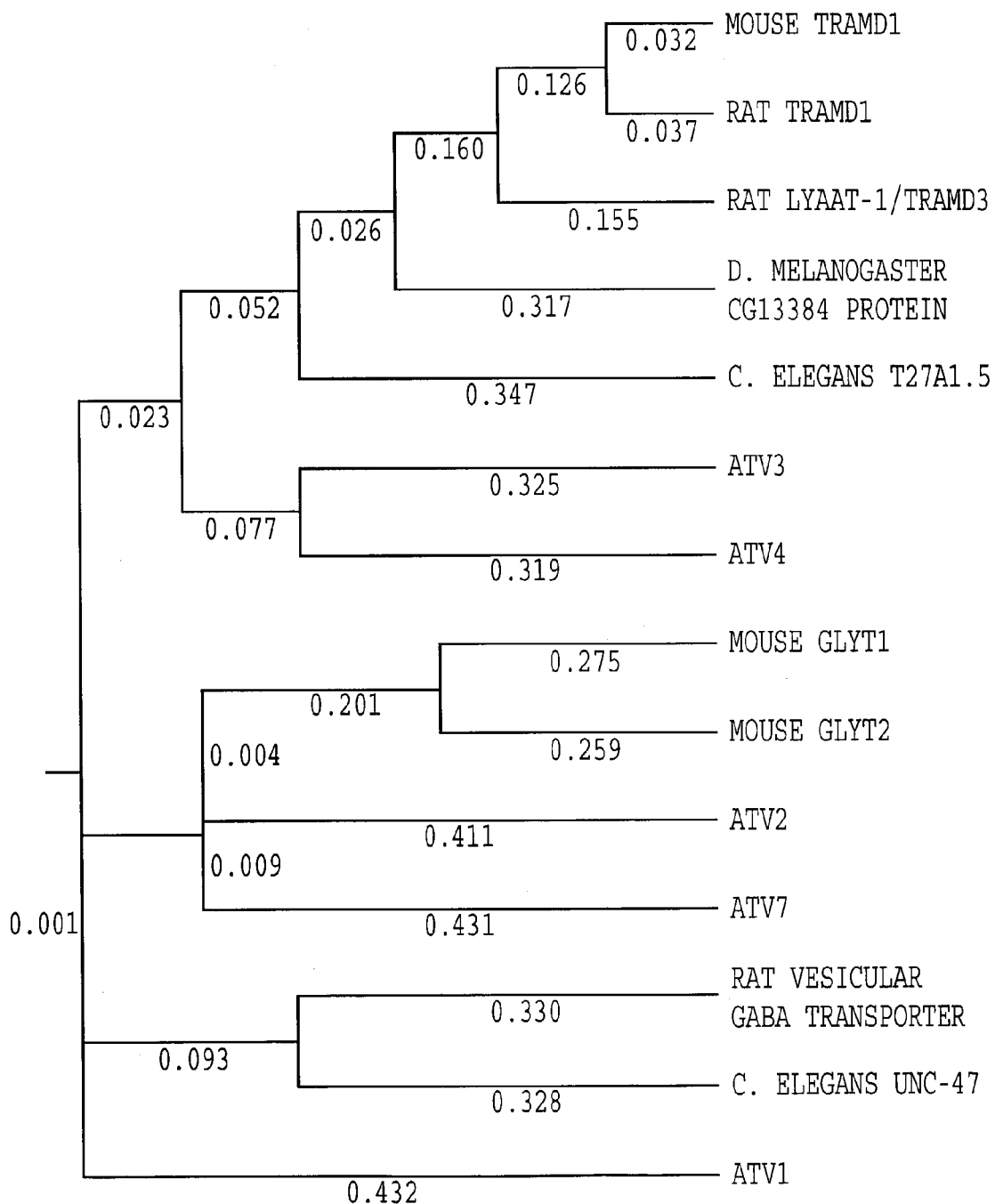
FIG. 25 depicts the phylogenetic relationship of tramd1 to other cloned genes. Specifically, this dendrogram illustrates that tramd1 is closely related to, but distinct from tramd3/ LYAAT-1, and that these proteins along with the hypothetical proteins CG13384 from *Drosophila melanogaster*, and T27A1.5 from *Caenorhabditis elegans*, constitutes a new family of putative amino acid transport proteins. They are related to the yeast vacuolar amino acid transport proteins AVT3 and AVT4. Other AVT proteins, and vesicular GABA transport proteins are more distantly related. The glycine transporters Glyt1 and Glyt2 are shown also for comparison.

A fourth tramdorin-related sequence, tramdL, is defined by the EST cDNA 1388139 (SEQ ID NO:23)(FIGS. 8D, 9 and 25). tramdL contains only sequences that are homologous to exon 10 of tramdorin1. This cDNA is derived from a parathyroid adenoma, and is unusual in that its 5' end consists of sequences derived from a member of the STE20 family of kinases, STK4/Mst-1/Krs-2 (FIGS. 11A-B; Creasy et al., *J Biol Chem* 270:21695 (1995); Taylor et al., *PNAS USA* 93:10099 (1996)), located on human chromosome 20. The STK4/Mst-1/Krs-2 cDNA fragment is fused to 3' sequences of tramdL [(FIG. 11C, located on chromosome 5. Human STK4/Mst-1/Krs-2 and tramdL sequences. EST cDNA 1388139 encodes a fusion gene product that fuses 5' MST kinase sequences to tramdorin 3' sequences at a splice junction. Genomic sequence from nucleotides 8189548 to 8196472 of human chromosome 20 contig NT011382, which contain exons 6-9 of the serine-threonine kinase STK4/Mst-1/Krs2, are shown in FIG. 11C. The 5' end of EST cDNA 1388139, within exon 6, is shown as an asterisk in the genomic sequence. The portion of the conserved kinase domain that is encoded by exons 6-8 is shown in bold. The caspase-3 cleavage site that activates the kinase is shown in bold italic. In EST cDNA 1833139, exon 9 is spliced to tramdL on human chromosome 5. The nucleotide sequence of tramdL EST cDNA 1388139 (SEQ ID NO: 23) is shown in FIG. 22. Vector sequences 5' to the EcoRI site (GAATTC) and 3' to the polyA stretch have been deleted, as have all but 11 A's in the polyA stretch. The point at which the cDNA diverges at its 5' end from STK4/Mst-1/Krs2 sequences is marked with a dot (•). Sequences between this point and the termination codon are translated (SEQ ID NO: 71). MscI (TGGCCA) and DraI (TTTAAA) sites that were used to generate a tramdL probe are underlined. Human chromosome 5 genomic sequence between nts 55336 and 56128 on Celera scaffold sequence GA x2HTBL3TT27: 2500000-3000000 is shown in FIG. 11C, along with an open reading frame that is significantly conserved with the C-termini of tramd 1-3. An asterisk following the open reading frame denotes a termination codon, whereas the asterisk in the sequence denotes the location of the polyadenylation site of EST cDNA 1833139 FIG. 11C. The fusion between STK4/Mst-1/Krs-2 and tramd L involves the 5' splice site of STK4/Mst-1/Krs-2 exon 9, and a 3' splice site of tramdorin L FIG. 11D. Such a fusion is unlikely to result from an artifact of cDNA synthesis. A comparison of proteins encoded by STK4/Mst-1/Krs-2 and EST cDNA 1833139 is shown in FIG. 11E. Caspase-3 cleaves the peptide sequence DEMD (SEQ ID NO:57), thereby separating active p36 kinase from the 3' inhibitory domain. In the putative STK4/Mst-1/Krs2-TramdL fusion protein (SEQ ID NO:71), the C-terminus of STK4/Mst-1/Krs2 is replaced by tramdL peptide sequences that include a complete transmembrane domain, shown inserted in a membrane. The kinase activity of C-terminal deletions of STK4/Mst-1/Krs-2 (Creasy et al., *J Biol Chem* 271:21049 (1996)) suggests that an STK4/Mst-1/Krs-2-tramdL fusion protein would retain some kinase activity.

Figure 23A:
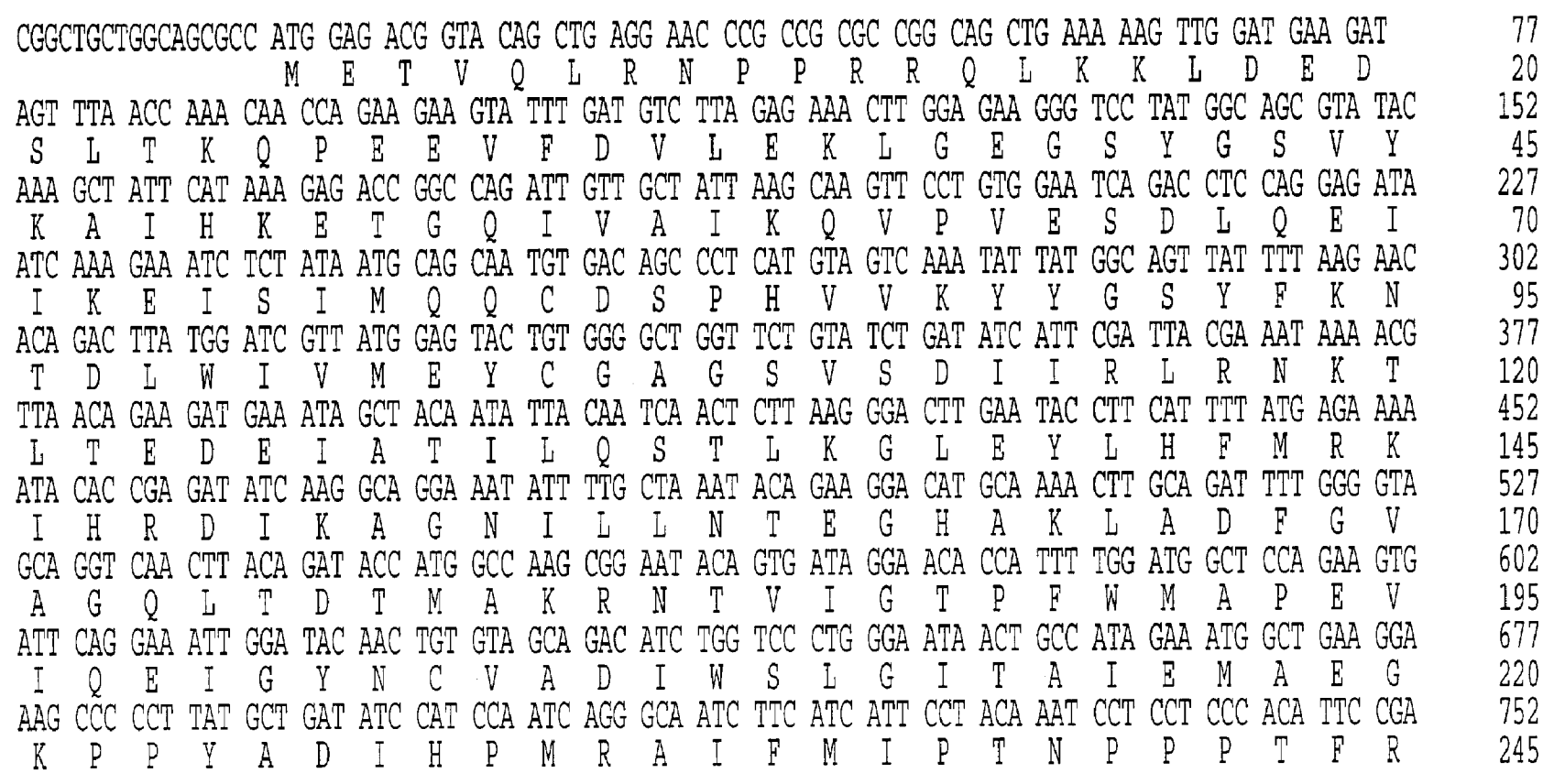
Figure 23B:
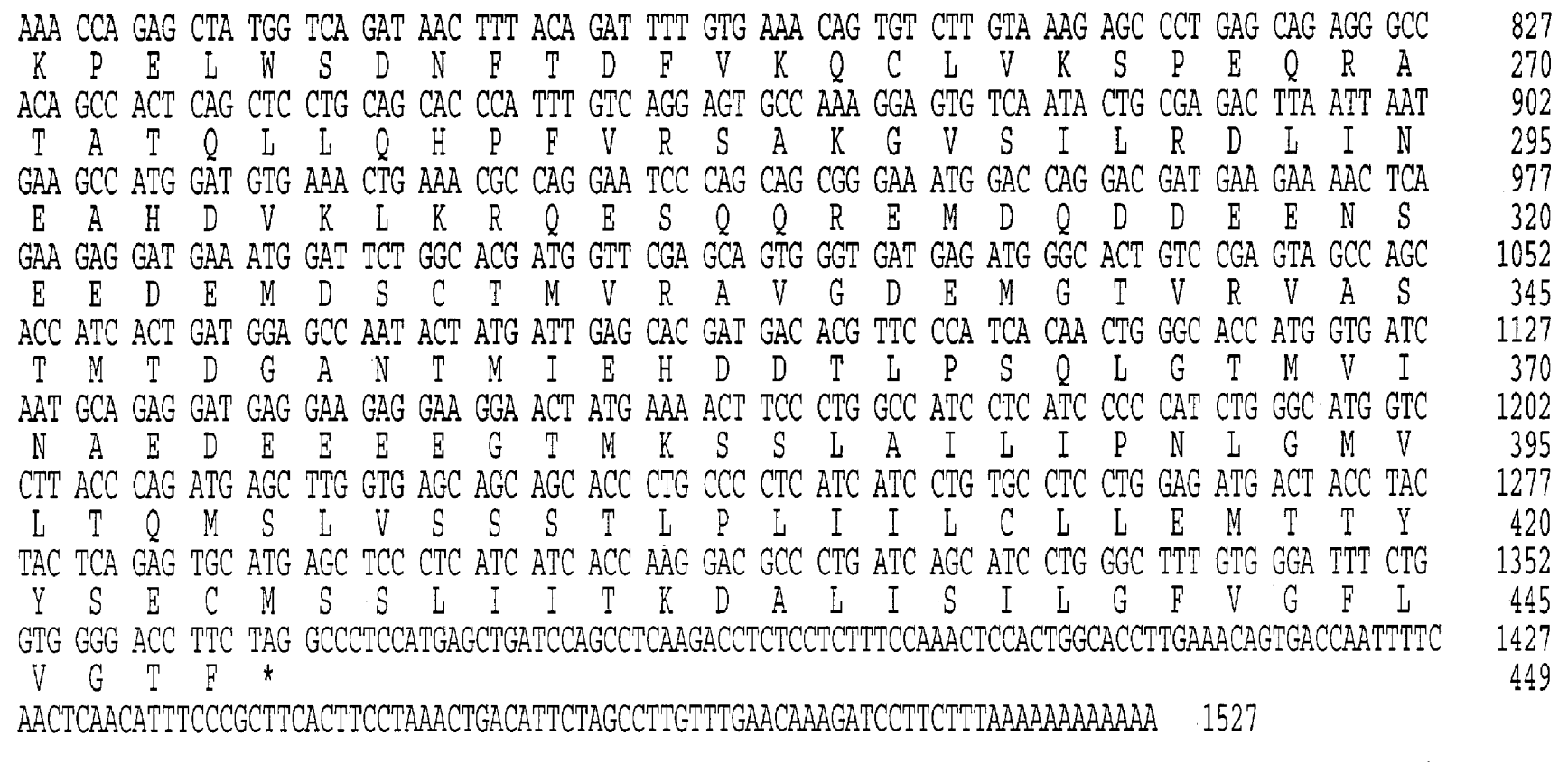

Comparison of the genomic sequences for STK4/Mst-1/Krs-2 (SEQ ID NO:27) and tramdL (SEQ ID NO:29) reveal that the fusion site corresponds to a 5' splice site in the STK4/Mst-1/Krs-2 gene, and a 3' splice site in tramdL FIG. 11D. Such a fusion is unlikely to be an artifact of cDNA synthesis. This observation raises the possibility that tramdL resides near a parathyroid tumor translocation breakpoint, between chromosomes 20 and 5, that results in expression of a STK4/Mst-1/Krs-2-tramdorinL fusion protein. The predicted fusion protein encoded by EST cDNA 1388139 is depicted in FIG. 22 (SEQ ID NO:71), and a predicted fusion protein sequence containing additional 5' human STK4 sequence is depicted in FIG. 23A and FIG. 23B (SEQ ID NO: 44). STK4/Mst-1/Krs-2 contains a C-terminal inhibitory domain (Creasy et al., 1996) that is cleaved by Caspase-3 to generate a cleavage product, p36, with kinase activity (Graves et al., *Embo J* 17:2224 (1998); Lee et al., *Oncogene* 16:3029 (1998); Watabe et al., *J Biol Chem* 275:8766(2000)). The STK4/Mst-1/Krs-2-tramdorinL fusion protein would replace STK4/Mst-1/Krs-2 C-terminal sequences with a C-terminal transmembrane domain FIG. 11E. Based on the activity of C-terminal deletions of STK4/Mst-1/Krs-2 (Creasy et al., *J Biol Chem* 271:21049 (1996)), the fusion protein may retain kinase activity, and may represent an important aspect of the etiology of parathyroid tumors. However, the present invention does not require an understanding of the underlying mechanism, and the invention is not to be limited to any particular mechanism.

Example 7

This example describes the expression pattern of human tramdorin genes. To determine the tissues in which the various tramdorin genes are expressed, a northern blot of RNA derived from 12 human tissues was sequentially hybridized to radiolabelled cDNA probes that correspond to tramd1, 2, 3 and tramdL FIGS. 12A-D. A human multitissue northern blot was purchased from OriGene Technologies, Rockville, Md., and probed sequentially with a 440 bp EcoRI+Nco fragment of human tramd2 EST1837427, a 340 bp MscI-DraI fragment of human tramdL EST1388139, a 850 bp StuI+KpnI fragment of human tramd3 EST2549054, a 355 bp EcoRI+PvuII fragment of human tramd1 EST3184556, and GAPDH. Hybridization to a GAPDH probe shows that RNA is present in all lanes. Phosphorimager exposure times were 2 weeks for tramdorins 1 and 2, one week for tramd3 and overnight for GAPDH.

Each probe produced a distinct hybridization result see FIGS. 12A-D. The tramd1 probe hybridized to a 4 kb transcript that appears to be expressed only in muscle and kidney. Tramd2 appears to be encoded by a 3 kb transcript that is expressed only in testes. Tramd3 is the most widely expressed of the tramd genes; it is encoded by a 7 kb transcript that is present in every tissue except liver and muscle. It is most highly expressed in brain, in which an alternative 9 kb tramd3 transcript is seen also. Its pattern of expression is nearly complementary to that of tramd1; both genes are expressed together only in kidney. In contrast to tramd1-3, no expression was observed for tramdL (data not shown). Either the gene is not expressed, consistent with the inability to find 5' sequences for it, or it is expressed only in tissues not represented on the northern blot. The differences in the sizes of transcripts that are hybridized by the various tramd probes also demonstrates that in spite of the considerable amino acid conservation between the tramd proteins, cross-hybridization between the tramd genes in minimal under the conditions used.

Example 8

This example demonstrates the conservation among human tramdorins. Translation of the known putative coding exons for tramdorins 1, 2 and 3 indicate that these proteins are highly conserved FIG. 13A-B. Comparison was by the Clustal W algorithm (Thompson et al, *Nucleic Acids Res* 22:4673 (1994)). Tramd1, tramd 2 and tramd3 appear to have ten coding exons except for the N-terminus (first coding exon sequences). Consensus glycosylation sites in the putative second extracytoplasmic loop (FIG. 3B), amino acids 181-183 and 190-192 are conserved in tramdorins 1 and 3, but not in tramdorin 2.

Example 9

This example demonstrates the conservation of tramdorin proteins between different species.

Figure 14A:
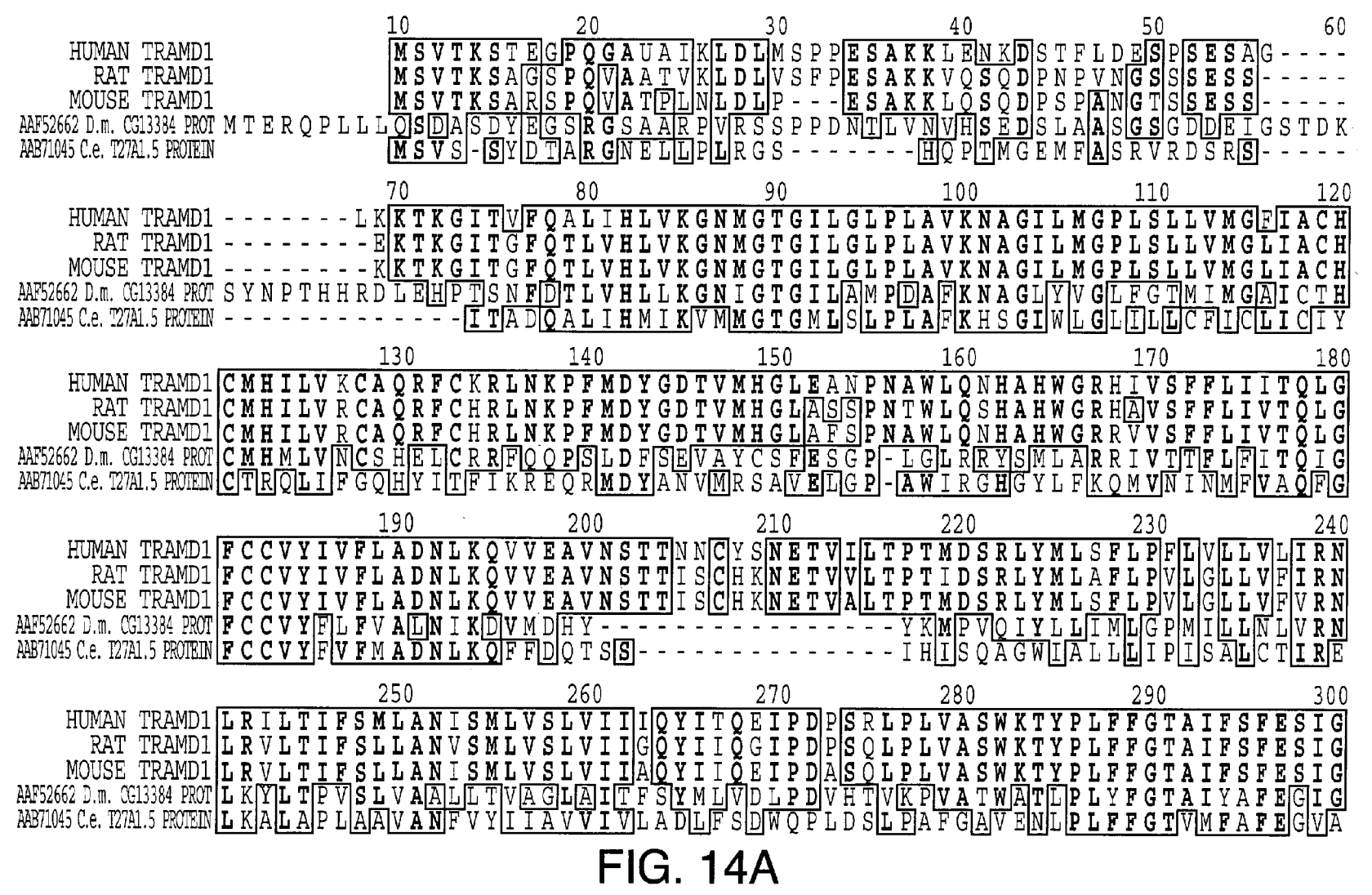

Clustal W analysis of putative tramdorin 1 proteins from human, rat, mouse and two invertebrate proteins that were identified by genome sequencing is shown in FIGS. 14A-B. The most closely related sequences to tramdorins are putative proteins that have been derived from the *Drosophila, Caenorhabditis elegans* and *Saccaromyces cerevisiae* genome sequences FIGS. 14A-B. Mouse tramd1 protein is 39% identical to *Drosophila* protein CG13384, and 32% identical to the T27A1.5 protein from *C. elegans*. The functions of these proteins in invertebrates may be related to tramdorin function in vertebrates. If so, tramdorins would be required for a function that is conserved by evolution, and predates the origin of myelin. The vertebrate proteins to which the tramdorins are most closely related are vesicular γ-aminobutyric acid (GABA) transporters (VGATs; FIGS. 15A-B; (McIntire et al., *Nature* 389:870 1997; Sagne et al., *FEBS Lett* 417:177 (1997)), to which mouse tramd1 is 21-22% identical. Note that transmembrane domains 1-10 of (McIntire et al., *Nature* 389:870 (1997)) correspond to predicted transmembrane domains 2-11 of tramd 1. GABA is the principal inhibitory neurotransmitter in the brain (reviewed in Zigmond, Fundamental Neuroscience, Academic Press, San Diego Vol., pp.xvi, 1600 (1999)), and VGATs are thought to pack GABA into vesicles prior to exocytosis into the synapse. The similarity between VGATs and tramdorins suggests that the latter may also transport small molecule(s) with significant biological importance. Furthermore, the observation of neurons with GABA, but without VGAT, suggests the existence of additional GABA transporters (Chaudhry et al., *J Neurosci* 18:9733 (1998)).

Example 10

This example presents the structure of the mouse tramdorin 1 and tramdorin 3 genes.

The organization of the mouse tramd1 gene was studied to understand better the origin of the alternatively spliced tramdorin cDNAs, and as a preliminary step toward generating mice that lack tramd1 function. A 129 mouse genomic library in bacteriophage λ was screened with a probe consisting of a 720 bp XhoI-NcoI fragment from cDNA 1920302 that contains sequence from exons 1-6. Three phage were isolated FIG. 16A. In addition, a 129/Sv bacterial artificial chromosome (BAC) library (Research Genetics, Huntsville, Ala.) was screened using the polymerase chain reaction (PCR) with primers 5' GCT GCC ACA AGA ACG AGA CG 3' (SEQ ID NO:58) and 5' ATG ATG ACC AGG CTG ACC AGC 3' (SEQ ID NO:59), that amplify 169 bp of exon 6. A single tramdorin-containing BAC was isolated. Subclones from the BAC and from the lambda phage were sequenced to determine the structure of the 5' end of the tramdorin gene. A partial restriction map of mouse tramd1 is shown at the top of the FIG. 16A. The exact location of exon 5 relative to exons 4 and 6 is unknown, and the sizes of introns between exons 7-10 are unknown. Shown below the map are three tramd1 EST cDNAs that define tramd1 exons. Genomic regions that have been sequenced are shown as thick lines below the cDNAs, and below them, select subcloned fragments are shown FIG. 16A. The genomic sequence 3' to exon 7 corresponds to sequence in EST cDNA 1363993, indicating that this cDNA is partially spliced. Exons 8,9, and 10 are defined by sequences from the Ensembl database. Mouse tramdorin 1 genomic sequences are presented in (SEQ ID NO:7). Untranslated exon sequences are shown without spacing between the nucleotides, whereas the tramdorin open reading frame is marked by triplet nucleotide spacing.

Mouse and human tramd1 genomic sequences were compared using the Pustell homology program (Pustell et al., *Nucleic Acids Res* 10:51 (1982a)). The exons were highly conserved, but in addition, short stretches of intronic and 5' sequences were also conserved (SEQ ID NO:7); these sequences may be important for tramd1 RNA transcription or processing. Notably, the intron 3' to exon 7, which is unspliced in mouse EST cDNA 1363993 and human cDNA htramd1#1, contains several such conserved sequences. In (SEQ ID NO:7), nucleotides that are conserved between mouse and human in orientation and spacing relative to one another are shown in bold. Nucleotides and exons are numbered to the right. Genomic sequence for the coding region of exon 10 has not been determined, and therefore exon 10 is listed in parentheses opposite a gap in the sequences that contains it. Restriction sites that correspond to the endpoints of subcloned fragments are shown in italics. Sequences between nucleotides 5188 and 5563, and 14823 and 17056 are derived from the Ensembl mouse genome sequence database and are derived from C57BL/6; all other sequences are derived from a129/Sv BAC.

To determine if the BAC contained genomic sequences for additional mouse tramdorin genes, plasmids that contained shotgun-cloned BAC DNA were arrayed on dot blots. Sequence analysis of clones that hybridized to radiolabelled tramd1 cDNA probes revealed that in addition to tramd1 sequences, the BAC also contained tramdorin 3 sequences FIG. 16B. Exons 2-8 were defined by homology to mouse tramd1 or human tramd3. Sequenced regions are shown below the exons; these sequences were obtained from the ends of the cloned fragments shown at the bottom of FIG. 16B, or from the Ensembl mouse genome sequence database.

Mouse tramdorin 3 genomic sequences (exons 1-11 and a possible 12$^{th}$ exon) are presented in (SEQ ID NO:8). Mouse genomic sequences encompassing the tramdorin3 gene are shown. Tramd3 exons, as defined by inclusion in 5' and 3'RACE cDNA clones, and a PCR-amplified cDNA, are shown in bold. The initiation ATG codon, TAA stop codon and a putative AATAAA (SEQ ID NO:60) polyadenylation site, are underlined. The sequence was assembled as follows: Unclipped sequences with homology to mouse tramd3 cDNA sequences were downloaded from the Ensembl trace server (http://trace.ensembl.org), and assembled using the AssemblyLIGN software (Oxford Molecular). These sequences are derived from C57BL/6 mice. In addition, mouse tramd3 genomic sequences from strain 129/Sv were obtained from subclones of a mouse BAC clone that was isolated on the basis of its containing mouse tramd1 sequences. These 129/Sv sequences are shown in the figure in italics. Several introns are not represented by complete sequence. The amount of missing sequence is estimated based on the size of the corresponding intron in human tramdorin3, with the exception of the distance between exon 11 and a possible 12$^{th}$ exon that was identified on the basis of homology to RACE cDNA mtramd3R3'58#37. In this case, the distance is defined by the estimated 4 kb length of clone G10P619257, end sequences from which are homologous to exon 11 and the 3' end of RACE cDNA mtramd3R3'58#37. Note that the exon numbering differs between mouse and human. Mouse exon1 is most homologous to human exon1b. Mouse exon 8 is homologous to human exon10. Two putative polymorphisms between C57BL/6 and 129/Sv mice were identified. A stretch of 9 C residues in intron 6, marked by an asterisk, is 12 C residues in C57BL/6 mice. The W at position 5539 may represent sequencing error or polymorphism; it is an A in 129Sv sequence, and a T in C57BL/6 sequence. Discrepancies between cDNA and genomic sequence may reflect polymorphism between C57BL/6, 129/Sv and Swiss Webster, the strain from which the cDNA that was used for RACE was derived; alternatively, they may be sequencing errors. These are listed below:

465 G-A in exon 1 12250 GTCA-TTTT, and 12272 G-T, in exon 11: likely genomic sequencing errors, based on comparison of the alternative translated sequences with human tramd3 and/or mouse tramd1

A comparison between mouse and human tramdorin 3 is presented in FIG. 17. The amino acid sequences of tramd3 are highly conserved between mouse and human, similarly to human and mouse tramd1 FIGS. 14A-B. Additional comparisons between human tramdorins 1 and 2 and mouse tramd3 confirm that this mouse locus is the homolog of human tramd3 (data not shown).

Because BACs typically contain approximately 100 kb of DNA, the presence of tramd1 and tramd3 sequences in the same BAC suggests that these genes may reside more closely to one another in mice than they do in humans.

Example 11

This example provides putative and composite cDNAs for different tramdorins.

A. Putative cDNA for human tramdorin 1 (SEQ ID NO:3) and its amino acid sequence (SEQ ID NO:19) is shown in FIG. 9A and FIG. 9B. Exons 8 and 9 of this cDNA were identified by sequencing EST cDNA 3184556, whereas exons 7, 8, and part of the 3' untranslated region were found in htramd1#1, which was isolated from a human sciatic nerve cDNA library kindly provided by Dr. James Lupski of Baylor University. The remaining exons were identified as follows: A file that contains the sequence in the Celera human genome scaffold GA x2HTBL3TT27e2.5-3.0 was generated using MacVector software (Oxford Molecular Ltd.). This sequence was shown by BLAST searches of the Celera database to contain regions of homology to the mouse tramd1 cDNA, and to human tramd1 EST cDNA 3184556. 30 kb chunks of this sequence, from nucleotides 1 to 150,000 were analyzed for homology to mouse tramd1 EST cDNA 1920302, human tramd1 EST cDNA 3184556, human tramd2 EST cDNA 1837427, and human tramd3 EST cDNAs 1733180, 2549054, and DFKZp434×1123 using the MacVector Pustell homology program (Pustell et al., *Nucleic Acids Res* 10:51 (1982a)). Multiple regions of homology on the human genomic sequence were found, but only those in the correct order and orientation relative to known exons 6, 7 and 8 were considered further as candidate exons. The genomic DNA flanking candidate exons was examined manually for 5' and 3' splice sites with close matches to the consensus human splice sites (Senaphthy et al, *Methods Enzymol* 183:252 1990). Sequence between the splice sites was translated in all three reading frames. If the amino acid sequence in a reading frame displayed conservation to the amino acid sequence of mouse tramd1 or human tramd3, the region of homology was considered a bona fide exon. In this manner, all ten coding exons of human tramd1 were identified. Note that non-coding exons were not identified.

B. Putative cDNA for human tramdorin 2 (SEQ ID NO:4), and the corresponding amino acid sequence (SEQ ID NO:20) is shown in FIGS. 11A-B. Exons 8-10 were identified by inclusion in EST cDNA 1837427. Remaining exons were identified as described above for human tramd1, or by homology to mouse tramd2 cDNA. This cDNA contains the entire human tramd2 protein coding region, but does not contain the entire 3' untranslated region. In the figure, vertical lines mark exon boundaries; exons are labeled to the right of the sequence.

C. Composite human tramd3 cDNA and the corresponding amino acid sequence is shown in FIG. 18A and FIG. 18B. Nucleotides 1-1311 are derived from EST cDNA 2549054, whereas nucleotides 641-2057 are derived from EST cDNA DFKZp434G1123. The two cDNAs overlap between the 5' end of DFKZp434G1123, which is marked by a dot (•) at nucleotide 641, and an exon boundary between nucleotides 1311 and 1312, at which their sequences diverge. A diagram of alternative human tramd3 cDNAs is shown in FIGS. 8A-D, and the full genomic sequence for the human tramdorin 3 gene is contained within the sequence presented in SEQ ID NO:26. The locations of exon boundaries at which alternative cDNAs diverge are marked with vertical slashes (|). An additional alternative human tramd3 EST cDNA, 1738130, possesses different 5' and 3' ends from EST cDNA 2549054 and diverges from it at the exon boundaries shown between nucleotides 146 and 147, and 875 and 876. Both EST cDNAs 1738130 and 2549054 diverge at their 3' termini from DFKZp434G1123, and encode truncated proteins. The putative initiation ATG is shown in bold and is a good match to the Kozak consensus (Kozak, *Nucleic Acids Res* 15:8125 (1987)). Two ATG sequences reside 5' to the consensus start site in EST cDNA 2549054, as does one in EST cDNA 1738130; they do not match the Kozak consensus and therefore are not likely to be used. The sequences of EST cDNAs 2549054 and 1738130 converge at a splice site five nucleotides 5' to the putative initiation ATG; the context for this ATG in EST cDNA 1738130 (CTGACTGCCATGT) is a slightly weaker match to the Kozak consensus start site than its context in EST cDNA 2549054. Thus it is possible that mRNAs corresponding to EST cDNA 2549054 are translated more efficiently than those that correspond to EST cDNA 1738130. The number of A residues at the 3' end of EST cDNA DFKZp434G1123 has been arbitrarily shortened to 12.

D. Composite mouse tramdorin2 cDNA and corresponding amino acid sequence is shown in FIG. 19A and FIG. 19B. Mouse tramdorin2 cDNAs were isolated from a mouse testicle cDNA library (Ambion) by 5' and 3' RLM-RACE (Maruyama et al., *Gene* 138:171 (1994); Schaefer, *Anal Biochem* 227:255 (1995)), using a FirstChoice™ RACE-ready cDNA Kit (Ambion), and the following primers, located in exon 10:

5' AGGCTGTGCGGACAGTCAGGTCTA 3' (SEQ ID NO:61)

5' AGACGACATAGGGGACGATGATCTCAGC 3' (SEQ ID NO:62)

5' GCTGTACCAGTCAGTCAAGCTGAT 3' (SEQ ID NO:63)

Sequences from the 5' and 3' RACE cDNAs were used to generate the composite DNA sequence. Vertical bars in the nucleotide sequence denote exon boundaries. The absence of a consensus polyadenylation site, and the observation that the poly(A) sequences at the 3' end are found in genomic DNA, indicate that the 3' RACE cDNA is not full length.

E. Composite mouse tramdorin 3 cDNA and corresponding amino acid sequence is shown in FIGS. 20A-B. Mouse tramdorin 3 cDNAs were obtained as follows: 5' and 3' RACE cDNAs were amplified from Swiss Webster mouse brain RACE-ready cDNA (Ambion) by 5' and 3' RLM-RACE (Maruyama et al., *Gene* 138:171 (1994); Schaefer, *Anal Biochem* 227:255 (1995)), using a FirstChoice™ RACE-ready cDNA Kit (Ambion), and the following primers:

5' RACE primers:
5'-CAGCAGGGAGAAGATGGACAACACAC-3' (SEQ ID NO:64)
5'-AGCTGAGTGACGATGAGGAAGAAGTCCAC-3' (SEQ ID NO:65)

3' RACE primers:
5'-CTATGGGGACACGGTGATGTATG 3'. (SEQ ID NO:66)
5'-GGGGAAGGCGCATCGTGGA 3'. (SEQ ID NO:67)

A mouse tramd3 cDNA clone that contains sequences from exon 3 to exon 11 was obtained by PCR amplification of the same brain RACE-ready cDNA using primers 5'
CCTCTCAGCCTGCTGGTGATTG 3' (SEQ ID NO:68) and
5' GGACACTACTGGGAGACACACAGG 3'. (SEQ ID NO:69)

All cDNAs were cloned into pCRII (Invitrogen) resulting in GAATTCGGCT (SEQ ID NO:70) sequences flanking the cDNAs. In FIGS. 23A-23C, vertical lines mark exon boundaries; exons are labeled to the right of the figure The composite mouse tramd 3 cDNA shown in FIGS. 20A-B contains the entire tramd3 protein coding region, but does not contain the entire 3' untranslated region. It was made by combining sequences from 5'RACE cDNA clone mtramd3R5'50#22, a 580 bp cDNA which contains exons 1-5 and part of exon 6, and clone 61-45, a 1250 bp cDNA which was PCR amplified from mouse brain cDNA using primers that are specific for sequences in exon 3 and 11.

FIGS. 20C shows mouse tramd3 3' RACE cDNA 58#37. This cDNA may represent an internally deleted tramd3 cDNA. It fuses sequences from exon 7, shown in parentheses because its 3' sequences are missing, to putative tramd3 3' untranslated sequences that include a polyadenylation site. These sequences are denoted with a question mark, because it is unknown whether they represent a separate exon, or the 3' end of exon 11.

Figure 20D:
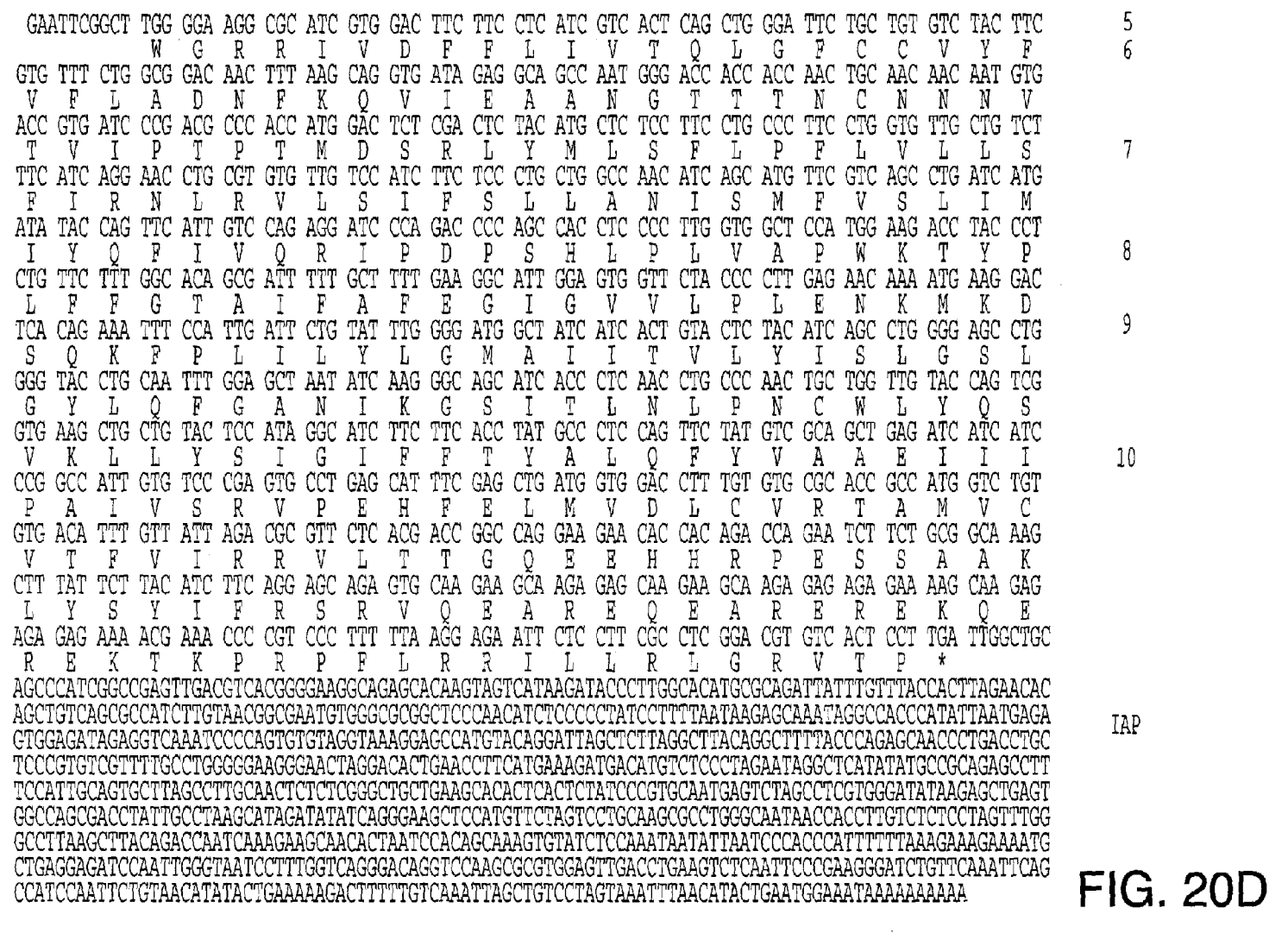

FIGS. 20D shows mouse tramd3 3'RACE cDNA 56#22. Similar alternatively spliced cDNAs that truncate the tramd reading frame have been found for mouse tramd1 and human tramd3. These observations suggest that such splicing events may have biological importance, perhaps by generating a truncated protein that could function as a dominant negative regulator of tramd activity. This cDNA contains a splice junction between exon 10 and an intracisternal A particle (IAP) repeat sequence (Aota et al., "Nucleotide sequence and molecular evolution of mouse retrovirus-like IAP elements." Gene 56:1-12 (1987); Ono, "Molecular biology of type A endogenous retrovirus" Kitasato Arch Exp Med 63: 77-90 (1990)). Due to the repetitive nature of the IAP sequences, the location of the putative tramd3 IAP sequence could not be determined.

Example 12

This example describes an assay to identify the mouse and human tramdorin ligands.

COS-7 cells are transfected with Lipofectin (Life Technologies, Grand Island, N.Y.), as described in Sagne et al. (2001; supra). Briefly, 1 day before transfection, 50,000 cells/well are plated in 24-well dishes. The day of transfection, cells are washed once with 0.5 ml of serum-free medium and then incubated 16-20 h with 250 µl of serum-free medium containing a complex formed by 3 µl of Lipofectin and 1 µg of pcDNA3 or pcDNA3-tramdorin. The tramdorins to be tested will include mouse tramdorin 1, mouse tramdorin 2, human tramdorin 1, human tramdorin 2 and human tramdorin 3. pcDNA3.1 is suitable for expression of cDNAs. One milliliter of medium supplemented with FCS is added on the following day, and transport assays are performed 3648 h after the beginning of transfection. Cells are washed twice with 0.5 ml of Krebs-Ringer (KR) phosphate buffer (146 mM NaCl/3 mM KCl/1 mM $CaCl_2$/1 mM $MgCl_2$/10 mM $KH_2PO_4$/$K_2HPO_4$) adjusted at pH 7.5 and then incubated for 15 min at 26° C. in KR buffer adjusted at pH 5.5, supplemented with 0.5-1 µCi of [$^3$H]GABA or [$^3$H] labeled amino acids of interest and 100 µM GABA. Reaction is terminated by two washes with ice-cold KR buffer at pH 7.5. Cells are lysed in 0.1 N NaOH, and their radioactivity is measured after neutralization by scintillation counting in Aquasol (Packard). [$^3$H]GABA, L-[$^3$H]glutamine and L-[$^3$H]glutamate are available from Amersham Pharmacia; L-[$^3$H]proline and L-[$^3$H]alanine are available from NEN.

Example 13

Transfection of Mouse Tramdorin1

A 1566 bp BglII-XmnI fragment of mouse EST cDNA 1920302 (which defines a 2.5 kb cDNA (SEQ ID NO:13/GenBank Acession No.: AI 1780664), containing the entire coding region, was cloned between the BamHI and EcoRV sites in the expression plasmid pcDNA3.1 (Invitrogen) and transiently transfected into Cos, HeLa, and 293 cells. The cells were grown in low-glucose Dulbecco's modified Eagle's Medium (DMEM) supplemented by 10% fetal bovine serum (FBS) and antibiotics (100 µg/ml penicillin/streptomycin) in a humidified atmosphere containing 5% $CO_2$ at 37° C. Both Lipofectin (Gibco-BRL) and plasmid DNA were incubated in Optimen for 30 min in RT, then combined for another 15 min. The cells (approximately 80% confluent) were washed with Optimen, then incubated with the combined Lipofectin/DNA solution for 6 h at 37° C. After 6 h the cells were washed once with Hank's BSS (calcium or magnesium free) and incubated for 3 days in DMEM at 37° C., then replated for immunoblotting or immunostaining.

Example 14

Immunoblotting

Plates of confluent cells in 100 mm plates were harvested in cold Dulbecco's PBS lacking calcium and magnesium (Life Technologies). The cell pellet was lysed in ice-cold 50 mM Tris, pH 7.0, 1% SDS, and 0.017 mg/ml phenylmethylsulfonyl fluoride (Sigma), followed by a brief sonication on ice with a dismembrator (Fisher Scientific). Protein concentration was determined using the BioRad kit (Bio-Rad Laboratories) according to manufacturers instructions. For each sample, after a 5-15 min incubation in loading buffer at RT, 100 µg of protein lysate were loaded onto a 12% SDS-polyacrylamide gel, electrophoresed, and transferred to an Immobilon-polyvinylidene fluoride membrane (Millipore) over 1 hr, using a semidry transfer unit (Fisher). The blots were blocked (5% powdered skim milk and 0.5% Tween-20 in Tris-buffered saline) overnight at 4° C. and incubated for 24 h at 4° C. in a rabbit antiserum against tramdorin1 (diluted 1:1,000). After washing in blocking solution and Tris-buffered saline containing 0.5% Tween-20, blots were visualized by enhanced chemiluminescence (Amersham) according to the manufacturer's protocols.

Example 15

Immunostaining

Transfected cells were plated onto plated onto 4-chamber glass slides (Nalge Nunc Intl) and incubated for 2-3 days to approximately 60% confluency. The cells were washed in PBS, and then fixed in acetone at −20° C. for 10 min, then blocked with 5% fish skin gelatin in PBS containing 0.1% Triton for 1 hr in RT. Cells were labeled with rabbit anti-tramdorin1 (1:500), and processed as described below. Unfixed rat sciatic nerves were embedded in OCT and immediately frozen in a dry ice-acetone bath. Five micron thick cryostat sections were thaw-mounted on SuperFrost Plus glass slides (Fisher Scientific) and stored at −20° C. Teased nerve fibers were prepared from adult rat sciatic nerves, and dried on SuperFrost Plus glass slides overnight at room temperature and stored at −20° C. Sections and teased fibers were post-fixed and permeabilized by immersion in −20° C. acetone for 10 minutes, blocked at room temperature for at least 1 hour in 5% fish skin gelatin containing 0.5% Triton X100 in PBS, and incubated 16-48 hours at 4° C. with various combinations of primary antibodies: rabbit anti-tramdorin1 (1:500); mouse Brat MAG (clone 513, Boehringer Mannheim, 1:100); mouse αLAMP1 (Developmental Hydridoma Bank 1:10). After incubating with the primary antibodies, the slides were washed, incubated with the appropriate fluorescein- and rhodamine-conjugated donkey cross-affinity purified secondary antibodies (diluted 1:100; Jackson ImmunoResearch Laboratories, West Grove, Pa.). Slides were mounted with Vectashield (Vector Laboratories, Inc., Burlingame, Calif.) and examined by epifluorescence with TRITC and FITC optics on a Leica DMR light microscope and photographed with a cooled Hamamatsu camera or followed by image manipulation with Adobe Photoshop.

All publications and patents mentioned in the above specification are herein incorporated by reference. Various modifications and variations of the described invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the described modes for carrying out the invention which are obvious to those skilled in the art are intended to be within the scope of the following claims.

SEQUENCE LISTING (76 sequences)

SEQ ID NO: 1 - DNA, 1752 bp, Mus musculus
aaaagcccacagctaggcaccagaacttccggtctaatgataccttcctcctccttggtcagtgttccccgtggaccacagcatcaaggactgatctgggagaggctgaaagtctgtggccaggcatacccaggagtcaggagccagaacctgagacctgctgtatggcttctcctgatgaaagcccactgagagcctgcggcagctgagtgctatacccctgctgcctgtccatcatggggaatgtgccgctgcttagagaagttggcaagtgtcagcggaatatgttcggtcggtctacagcctcctcaaaaggcagcagcaacagcagaagcagcagcagtacctccccaaagaagggccctcgcagggaagctgatgcgctaatgtttatacagatctttatccacctgttgaaaagcaacattggcacaggcttcctgggactgcccctggctgtgaaaaatgctggattgttggtggggcctgtcagcctcttggccatcggggcgctcacagtgcactgtatggatatcctgctgaactgtgcctgccatctcactcagagactgcagaggagttttgtgaactatgaagagaccacaatgtacagcctggaaacgtgtccaagtccttggctgaggacgcactcagtgtggggcaggtacgttgtgagcttcctgctgatcgtcactcagctgggcttctgcagcgtgtacttcatgtttctggcggacaacttacaacagatcatggaagaagcccacttcacctccaacgtctgccagccgaggcagagcctggtgatgacctccatcctggacactcgcttctatatgctcaccatcctgcccttcctcatcctgctggtgctcatccagaacccacaggtgttgtccatcttctctaccttggccaccatcaccaccctgagcagcctggctctgatcttcgagtatctcatccagaccccacaccacagcaacctgcccctggttgcaaactggaagactttcttgctgttctttggcacggctatcttcacctttgaaggcgtggggatggttctgcctctcaaaagccagatgaagagcccgcagcagttccccgctgtgctgtatctggggatgtcctttgtcatcttcctctacatctgcctggggactctgggctacatgaagtttgggacagacactcaggccagcatcaccctcaacttgcccatttgctggctgtaccagtcagtcaagctgatgtactctgtgggcatcttcttcacctatgccctccagttccacgtcccagctgagatcatcgtcccctatgtcgtctcaagagtgtctgagaactgggctctgttcgtagacctgactgtccgcacagccttggtctgcctgacctgtttctcagccgtcctcatcccccgcctggacctggtcatctccctggtgggctctgtgagcagtagcgccctggccatcatcatcccgccgctgctggagattgccacattttactctgagaacataagctgtgccaccattgtcaaggacatcatgatcagcatcctgggcctcttagggtgtgtacttgggacataccaagccctgtacgagatgacccagcagacccacttttacatggccaactctacaagggtccacatataattacctatttttatttgaatagctcttcctttctccaccctctgttggatttgcattatatgtgttcatcaaaatccaaaaa

SEQ ID NO: 2 - DNA, 2034 bp, Mus musculus
ggctagaaaaccatggctaggggtcggcgctgaggctacgcgaggtgggctgagcaggagcgggagccagagccggagccggagccggagcgggagcccgggccgggcagggccaaccgctaccatgtccacacagaggcttcggaacgaagactatcatgactacagttccacagacgtgagccccgaggagagcccatctgaaggccttggcagcttctcccccggctcctaccaacgcttaggagagagcagtagcatgacatggttccagaccctgatccacctgctgaaaggcaacattggcaccggactgctggggctgcctctggcagtgaagaacgcaggcctcctgttgggtcctctcagcctgctggtgattggtatcgtggccgtgcactgcatgggtatcctggtgaagtgtgctcatcacttatgtcgtagactgaacaaaccctttttggactatggggacacggtgatgtatggactagaatgcagccccagcacctgggtccggaaccactcccactggggaaggcgcatcgtggacttcttcctcatcgtcactcagctgggattctgctgtgtctacttcgtgtttctggcggacaactttaagcaggtgatagaggcagccaatgggaccaccaccaactgcaacaacaatgtgaccgtgatcccgacgcccaccatggactctcgactctacatgccctccttcctgcccttcctggtgttgctgtctttcatcaggaacctgcgtgtgttgtccatcttctccctgctggccaacatcagcatgttcgtcagcctgatcatgatataccagttcattgtccagaggatcccagaccccagccacctccccttggtggctccatggaagacctaccctctgttctttggcacagcgatttttgcttttgaaggcattggagtggttctaccccttgagaacaaaatgaaggactcacagaaatttccattgattctgtatttggggatggctatcatcactgtactctacatcagcctggggagcctggggtacctgcaatttggagctaatatcaagggcagcatcaccctcaacctgcccaactgctggttgtaccagtcggtgaagctgctgtactccataggcatcttcttcacctatgccctccagttctatgtcgcagctgagatcatcatcccggccattgtgtcccgagtgcctgagcatttcgagctgatggtggacctttgtgtgcgcaccgccatggtctgtgtgacatgtgtgctggccatcctcatcccacgcctggacctggtcatctccctggtgggctctgtgagcagcagcgccctggccctcatcatcccgcccctgctggaggtggtcacctactatggagagggcattagccccctgaccgtcaccaaggatgccctcatcagcatcctgggcttcgtgggcttcgtggtggggacctacgagtctctgtgtgagctgatccagccaagccatagcgactcctctaccaattccaccagtgccttcatataaggatctgggtgtgctccctccaccagcctcaccctgtgtgtctcccagtagtgtccccacatcctcagacagggtctcatgtcaccagagttggctttgaacttgcttgctgtgtagtcaaggatgacgatgggctctcagttctcctaccgttgcctcaagtatggaggttactagcatgagctgccactcccagctggctcagagacctcaagcagatcatgtgagcatgcaccgcctctggaagccccatgcttctgtggacttccattcatgagactgactccatatgggcactcggaagtactcgtgtatacaaggctaaggacggggcgcagttcctcttcatagacactacgcacaagggtcattgtttacagttcctggggagagagcagaatccctgccttgccccaagctgcctctgtatcctgggcttccaaggaaccactaaacactaactgtggcccaaaaaaaaaaaa

SEQ ID NO: 3 - DNA, 3434 bp, Mus musculus
ttccagcttggccagagccagcccgggcacacaccactgtgctggggtgtacatctacactagacaccttcctgcttccctccttccagagcagacctctttgtcaccccgagctccttgtttcttaagcagtcatgtctgtgacaaaaagtactgagggtccccagggagccgttgccatcaaattggaccttatgtcgcctcctgaaagtgccaagaagttggagaacaaggactctacattcttggatgaaagtccttcagagtcagcaggcttgaagaagaccaagggcataacagtgttccaggccttgattcacttggtgaaaggcaacatgggcacagggatcctgggactacccctcgctgtgaagaacgcgggcatcctgatgggcccactcagtctgctggtgatgggcttcattgcctgccactgtatgcacatcctggtcaagtgtgcccagcgcttctgtaagaggcttaacaagccctttatggactatggggacacggtgatgcatggactagaagccaaccccaacgcctggctccagaatcacgctcactggggaaggcatatcgtgagcttcttccttattatcacccaacttggcttctgctgtgtgtacattgtgtttttggctgataatttaaaacaggtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggaaatcccagaccccagccggttgccactggtagcaagctggaagacctaccctctcttcttcggaacagccattttttcttttgaaagcattggtgtggttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggctgtaccagtctgtcaagcttctctacattgccggcatcctgtgcacctatgccctgcagttctacgtccctgcagaaatcatcatcccctttgccatctcccgggtgtcaacacgctgggcactgcctctggatctgtccattcgcctcgtcatggtctgcctgacatgcctcctggccatcctcatcccccgcctggacctggtcatctccctggtgggctccgtgagtggcaccgccctggccctcatcatcccaccgctcctggaggtcaccacattctactcagagggcatgagccccctcaccatcttcaaggacgccctgatcagcatcctgggcttcgtgggctttgtggtggggacctaccaagccctggacgagctgctcaagtcagaagactctcaccccttttccaactccaccacttttgttcggtgagcctggcactgctccttgcctaccagcacccgacttttaattatatggatctcttttttttttttttttttttttttgagacggagtttctgtcttgttgcccagactggagtacaatgatgcgatctcagctcaccacaacttcggcctcctgggttcaagcgattctcctgcctcagcctcccgagtagttgggattagaggcatggtccagcacgcctggctaattttgtatttttagtagagacggggtttctccatgttggtcaggctggtcttgaactcccaacctcaggtgatccacccaccccggcctcccaaaatgctgggatcacaggcgtgagccacctcgcctggccagatctcttttatatgcattatctttatgtcactgctttgccttttctctgggccaagtcatggtgaaacaagaaagctacaagctctaaatggtaattttttacatttttgttttgtttattacttcttcttttcatacctctggcattccactacattgtgagctttcccttggaaggctctggactctatccaagcttatgataattcacacaatgaatttcatacctagcgtggagctatgcaagaagcagccaccagagggccccaagtggcagcaactggccaaaggaggtgcagccagctaagactgtccacactttggcagacaaccggttttcccttttctgggtctgttcaaaaagcaaacattaagggtgggcacataatccacaagccagaaagttgtgcacggctccagtgttgagatgggtagggccaagatgaccagtgtgaaaactctcagatagaaaggagccatgcatattaaatgaggggcaacaaacatttcaaacgattagataacattttctcccaactcaaagatcccaacaatgaataggaggcatggaagtagatgtgccaatggggagggatgaggagtgaacatgaatattatttgaatagactttacctcttaattcttgcaacatgcattcttgattacctactgtgtgccaaacaagattttgtagaatattgcaaaaatgaccataaattcctcgtgataatgtgactttgcacctgctcctatgaaaagatgaagtctgtatctgtatcccttaaatttttttgcttgtttgtcggttttgttttgtgttttgtttttttgagatgaagtctcgctctgttgcccaggctggagtgcaatggcacaatctcggctcactgcaacctccacctcctgggttcaagcgattcttctgcctcagcctcccaagtagctaggattacaagtgcctgccactatgcctggctaatttttgtttttcgtagagatggggttttaccatgttggccaggctggtctcaaactcctgacctcaggtgatccacttgcctcggcctcccaaagtgctgagattacaagtgtgagccaccacgcccagcctctcccctttaaatttgatcttggccttgtaacttgctttggccaatgggacattagtaaatgtgatgcagtcagaggtttggtaataacctatgcatcaggacttacatcacttgctgctctatggagttgagaccaccaagtaaagcatcctgggctagcctaccggaggatcagagaccatgtggaacataaatgaatcatcccagttgagccctgtccgcagatcaaccagcctaccaacttccagacacgagtaaagccatcctagactatatccaaccccagtcaggctgacacagaccataagaattgtacagataatccacagaactgtgataaataataaagatgtttgtaattttaatacaaaaaaa

SEQ ID NO: 4 - DNA, 1703 bp, Homo sapiens
cccacgtccaggcaccaggacctccaatccaatggtgtcttcttcctcccagtcacactgttcactttgccctacagcagcaagggctaaactaggagaggccaaaagcccaggcttcagccagcagcacgcatccttggggttaggagccagcatctcaggtcagcagccatggtttctctggagaaagacccatcagaggctcattcagagccttaaccctgagcctctgccacctacccaccgtgttgaagatgtcattgcttggaagggactacaacagtgagctgaactccttggacaacggacctcagtcaccctcagagagcagcagtagcattacttcagagaatgtccatcctgctggagaagctggactatcgatgatgcaaactttgatccacttgttgaaatgcaacattggcacagggctcctggggcttcccctggccataaagaatgccggcttgttggtcggtcctgtcagccttctggccatcggggtcctcaccgtgcactgcatggtcatcctgttgaactgtgctcaacacctcagccagagactgcagaagacttttgtgaactatggagaggccacgatgtacggccttgaaacctgcccgaacacctggctgagggcccatgcagtgtggggaaggtacactgtcagcttcttattagtcatcacccagctgggcttctgcagtgtttattttatgtttatggcagacaatttacaacagatggtggaagaagcccacgtgacctccaacatctgccagcccagggagattctgacgctgacccccatcctggacattcgtttctacatgctgataatcctgcccttcctgatcctgttggtgtttatccagaacctcaaggtgctgtccgtcttctcgacattggccaacatcaccaccctggggagcatggctctgatctttgagtatatcatggaggggattccatatcccagcaacctacccttgatggcaaactggaagaccttcttgctgttctttggtacagccatcttcacatttgaaggcgtcggtatggttctgcctctcaaaaaccagatgaagcatccacagcagttttcttttgttctgtacttggggatgtccattgtcatcatcctctatatcttactggggacactgggctacatgaagtttgggtcagacacccaggccagcatcaccctcaacttgcccaattgctggttgtaccagtcagtcaagctgatgtactctatcggcatcttcttcacctatgccctccagttccacgtcccagctgagatcatcatcccgtttgccatctcccaagtgtcagagagctgggcactgtttgtagacctgtctgtccgctcagccttggtctgtctaacctgtgtctcagccatcctcatcccccgcctggacttggtcatctccctggtaggctccgtgagcagcagcgccctggctctcatcatcccagccctcctggagatcgtcatcttttactctgaggacatgagctgtgtcaccattgccaaggacatcatgattagcatcgtgggccttttagggtgtatatttgggacataccaagccctctatgagttgccccaacccatcagccattccatggccaactccacaggtgtccatgcataattatctgtttttattctaatagctctcccttcctcc

SEQ ID NO: 5 - DNA, 2055 bp, Homo sapiens
acgcgtgggcggctgccgggcagcaaaggaggatggcgaggggctgatactgaacccgggaagggtgggctgtgctgaagccagagccggagccggagctgggcaggacccacctcgccttcctcccggcgtggcagatgctccagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgcatcttggccatcctcatcccccgcctggacctggtcatctccctggtgggctccgtgagcagcagcgccctggccctcatcatcccaccgctcctggaggtcaccaccttctactcagagggcatgagccccctcaccatctttaaggacgccctgatcagcatcctgggcttcgtgggctttgtggtggggacctatgaggctctctatgagctgatccagccaagcaatgctcccatcttcatcaattccacctgtgccttcatatagggatctgggttcgtctctgcagctgcctacccctgccccatgtgtcccccgttacctgtcctcagagcctcaggtatggtccaggctctgaggaaagtcagggttgctgtgtgggaacccctctgcctggcacctggataccctgggccaggtaacctgagggcaggggagaggtggggtggcagacacgcagaagtgctactagtgacagggctgccatcgctcacctgtacctatttacacccagaactttccagctccccctcatcatgcctcctccttcctacctgcctcccctctgctggtgcacctcgcccaactcattcttactgcacagttcactttatttaacaattttcatgtcccccacctcatgttttcaccttttctgggccaggcatagattaagtaactgggaacgccccctctttataaagctgggcttctttctcatctctctcccaaaaaaaaaa

SEQ ID NO: 6 - DNA, 2436 bp, Rattus norvegicus
agagcaaactctctggccagctctactgagcccaacttacacctacacgcacacacacctccttcattgccctctccctactctgagcttgccctttctgaagccatcatgtctgtgaccaagagtgccgggagtccgcaggtggctgccactgtcaagctggaccttgtgtcgtttcctgagagtgccaagaaggtgcagagccaggatcccaatccagtgaatgggagctcttcagagtcgtcagagaagaccaagggcattacagggttccagacattggttcatctggtcaaaggcaacrtgggcacagggatcctgggactycccctggctgtgaagaatgcgggcatcttgatgggcccactcagcttgctagtgatgggcctcatcgcctgccactgtatgcacatcctagtccgatgtgcccagcgcttctgtcacagactcaacaagcctttcatggattatggagacacagtgatgcatggactggcttccagtcccaacacctggctgcaaagccacgcccactgggggaggcatgctgtgagcttcttcctcatcgtcacacagctgggtttctgctgtgtgtacatcgtgtttctggcggacaatttaaaacaggtagtagaagctgttaacagcacaaccatcagctgccacaagaacgaaacggtagttctgacgcccaccatagactctcgactctacatgctcgccttcctgcccgtcctggggcttctggtattcatcaggaacctccgcgtcctcaccatcttctccctgttggccaacgtcagcatgctggtcagcctggtcatcattggccagtacatcatccagggaattccagatcccagccagttgccactggtagcaagctggaagacctacccgctcttctttggaacagccattttttcattcgaaagcatcggcgtggtgctgcctctggaaaacaagatgaaggatgcccgccgcttcccaaccattctgtctttgggaatgtccatcatcaccaccctgtacattgccatcggggctctgggctacctgcggtttggagacgacatcaaagccagcatcactcttaacctgcccaactgctggctgtaccagtcagtcaagctcctgtatgtcgtcggcatcctgtgtacccatgccttgcagttctacgtccctgcggaaatcatcatccccctcgctgtctcccaggtgtcaaaacgctgggcactgcctgtggacctgtccatccggctcgccctggtctgcgtcacatgcatgctggccatcctcatcccccgcctggacctggtcctctccctggtgggctctgtgagcagcagtgccctggccctcatcatcccgcccctgctggaggtgaccacctactatggagagggcatgagccccctgaccatcaccaaggatgccctcatcagcatcctgggcttcatgggatttgtggtggggacctaccaggccctggatgagctgatcaggtccgggaacagtctccccctgtccaactccactatgtttattcagtgacagtgcctctcctcgcccacagtgacttacgttgtctatgtatcttttcacttcgtcttttctcttgtccaagacaagaaaaaacagacgtagcatatccccggcaccatgtgcgtctgcgcaaaggagatgggggccatctacaccacgtacaaggtgtagatagatggtcattaaaaacgaaaaatgttggtcattctctagttttccacactttggagacctcgcctgtggaagccgccatcttgtttctgtcatttatctaatttcttaccttgagtggagctatgtaaaaagcggccactaggaggcagcaagcgccagcttttggcagaaagtggtccctgccagctcaagttttggtcatttccttttcctgaccatgatggggatcactgcccccacatcagcattaagatggagggggccagggccagtcacaatgctcaggtaaaatgtcaccgtctatgttacagataaatgtgttgaactttctaaactttagctccaactcagaaatccagcagcgaccaagaaaaaggtaggctcaagtctctgagccaggggcagcagacagacatcatttgagtagttgttttttgttttttttttgtttttttgttttttttttttttacttctgaattcttgcaacaatgaacatcctctgttacctattggatatgaaggctcttatataatagattgggtaaaggtgttctaaaaacaaaacaaaacaaaaccactgctaatataacattgtggcttcgtgtaccaaacggtggagtctacagctcacccttgagtcttgaccttgtaacttgtcttggccaacagtaaaagtgttacaaatgccaaaaaaaaaaaaaaaaaaaaaaaaaaa

SEQ ID NO: 7 - DNA, 17177 bp, Mus musculus
  misc_feature (10446)..(10446): n is a, c, g, or t
  misc_feature (14328)..(14328): n is a, c, g, or t
  misc_feature (14988)..(14988): n is a, c, g, or t
  misc_feature (14991)..(14991): n is a, c, g, or t
  misc_feature (15654)..(15654): n is a, c, g, or t
  misc_feature (16336)..(16336): n is a, c, g, or t
  misc_feature (16360)..(16360): n is a, c, g, or t
  misc_feature (16366)..(16366): n is a, c, g, or t
  misc_feature (16374)..(16374): n is a, c, g, or t
  misc_feature (16376)..(16376): n is a, c, g, or t
  misc_feature (16383)..(16383): n is a, c, g, or t
  misc_feature (16397)..(16397): n is a, c, g, or t
  misc_feature (16399)..(16400): n is a, c, g, or t
  misc_feature (16402)..(16402): n is a, c, g, or t
  misc_feature (16419)..(16419): n is a, c, g, or t
  misc_feature (16421)..(16422): n is a, c, g, or t
  misc_feature (16424)..(16424): n is a, c, g, or t
  misc_feature (16426)..(16426): n is a, c, g, or t
  misc_feature (16439)..(16439): n is a, c, g, or t
  misc_feature (16786)..(16786): n is a, c, g, or t
  misc_feature (16792)..(16793): n is a, c, g, or t
gaattcccttttaggtagaagcctacctaacccaaagtcaactcaagtcaacttccaatccaaaggaagactaatgtttgcaccagtttatatgatctcagataaatacacacacacacacacacacacacacacataggcatgatggactattgttcagccattagaagggatgagatcctgctgtttgagggtatgtggagatcataatgttaagtaaaaggagtcggacacaggaagataaatacccctggaatcctaaactagagaggagaagagaggtcagtggaggccaggtaaggcagaggagactagacaagggaaagaaatggtaagaaaggagcagcataggatacatttccactccattacagaagggtgtttatggccagccatattatattataaatagctacaaaaggatacctttaaattttttttgacaaggtctcattaggtagccctgggtggcctgggactctctatatacaacaggctagcctctggctcagcgttccacctgcctctcccctccaagtgctgagattaaagatgtgcttcatcacacctggccaagagaactgcttcgaatgccttgtcacaaagatataatagatgtatgagacaatgaacactctaagtaccctgggttgctcaatatggagtctatacatatctcagataaccacaccgtgcctatgaagatatactgttgtgtttgtttaaaaggaagagagttgactcttgcccggaagagaagtgcaactcacaagatcagtgaatgaagaaggcacacacagccatatcttaggccccttcaaacccccatcccagcattccttattacctccctagactatcaggtgcacctcaagatcctatgcttcaacctgcatacaagaatgaaagaagtgggctggagagatggctcagcggttaagagcactgactgctcttccagaggtccagggttcaattcccagcaaccacatagtggctcacaaccatctgtaatgagatctgatgccctcttctggtgtgtctgaggacagctacagtgtacttatatacataaaataaatctttaaaaaaaaaatgaaaggagctccccacaccacctcaactctacagtgtgtgtgtgtgtgtgtgtgtgtgtgtgtgtgtgtgtgtgtgtgtgtgtaagtgtgtgtgtaagtgtgtacatttaagttgtacttggggtcagtaagtcacttcagagggtaaaggcatctgccagcaagccagaagacaagagcccagaacccacatgtagaaagagagagccagttcctacaagtcatcatccgaactccacacttgagctgtagtgcactcctgcacacgtgcgcgtgcacacacacacacacctctttctaaagtgtaactgagttacattcactcctctgaccttctactcagccctcagctttacagagaacgcccacccatgtgtctctggtcctcctgcctttagaagtcatatgcactctggcatctacttcatgtaatgaggtggtaaggctcagagtacagcagtgtcctctccagggttccaacgggctttgtggtggtgccacgctggaatccagctctccagatgcctggctcctcctgagtcctcaccctttcatctgaccagtagtaccacacactaggagtgtacacctttgtctcacccaacaaggttccttttggccatgatatacatgaagggaccctggtcaaacaccagtattccagctactcctattcaaaaggtctgaagattaaccccagattcttaatcaatttggagaggaaagcaaaattgatttcagccccatcccctgacaatctgcgtgtacagatctcattgcctggagggagcaaagctctttcgacaagatgaaatctaaaattagaaccaaactgtggaatcccaattgcaggttccacaaagcagcctgctactccacagaccaggaatagcaccatgtgatggtgccagacaagggaagttaggacactttgcaaaccacagccgggccacagttgactcagggcaaggacatgaagggtagggccagcacacttaaccaagaatcagtgtggcgatcaaagctgcaggcagcaggcctgctagatctggctagggtgcagcagggactcttccaagggatgagacctctgtcaaactgtcctttgccttttggagcctcagtttccaagaaacaaaacaacagtgctcccccaatgaagttgccagtttttttgtggagtctagcacataccactggggatgcaggaaggagcaggaaggggtgggggtgaacctcctctttgtagctttaaacattactattgtttatctatttgctagtgggatggggcgagtagggaatcagaggacaatttacaagagttccaccaggtgggctccagggatcaaactcaggttaccatgccgacagcaagcatctttactaatgaaccatctcccagcctggggtgagactctttaggagagaaaacaaaacaaaaacaggaactgggaagagataaatggctcagtcagtaaagtgtttgctgggcactaatggggactaagcttgatctccgaaacccacacaagagccaagcacagcttcatgtggctgcccgaggctataatcccactgctggtgtcagggtaaggatgcagaaaccggtgggattctggagctcactggccagatttgctgaactctaggttcaatgagagaccctgtctcaaaataacacaagatggaactgggcatagtgacacatgccttttgtcccagcacttaggaggcagagtcaggctgatctctgtgagctcaagaccagcctgatctacagagtgagtttcaggacagccatgggctacatagtatctccaaacctctgagtgtacacactatgcatgtatgcataggacacacagacgtgccacaagttcagaattgcacgccggaccctagaaagaaccctggtaagggacaggtccttcagagtctgtcttaggtgttcctgataccatgggggtgttttaagctacactgttggcacacagtacggcctcggtaaatgttgctttctgaggaggagatggtggtggggagactggtacaagaagaaaaatgctataatttgtagaagaggagagtttggctggttcgtttaccctgagcagagataatgacagagagcagaatcccaagaagctcccgagaccatcttccggtccagagctccaacccggaagccacattgtaaccttaagcagatcacacccggtcgcccctgaagcccctgaaccgtggcctgcccgggaaaacgcgcctgggactcatgcagaattcattcctttccttctccctccatggagccttcagaaagtaaaggcacctcttcagcagttctcaacctgtgggtggcgaccccgggaggggggggtgccacatatcaactctcctgcatatcagatatttacgtgccaattcataactggcaacagtttatgaagtagcaatgaaactgttatggctgagggtcaccacaacatgagtcactgtattaagtcagcactatgtttgaggaagacaccgcaaatccagctcttacctccacatatacacagcatgcacgcatgcatacaaacacacagacaggccacgagttcagaattacacgtgaaaccttagaaagagccctgctctaggtgaggtgccagctgcccctcccatcttcttagagctgactgcaggctggtaggacctgggaagcctgccctgagatgaagacaggaaggcattttttttcagagacagaaatgggtacccccttagcggagtgtgtaataaatagttcggctctcgtcattaaaattatcaggatagactggaaataaggctcagatgtggactgcttgcctaatatgcttaaaggcctgggtcctgcccccagttctgtataaaaacagatgcggtggtggacacatctgtaattccagcactcaggaggtagaggcaggtggctcaaaagttctggatgatccttagctatctaatgaattacaggccactttgggctacaggagatcctgtcacacacgaaagaaagaaagaaagaaagaaagagagagagagagagagagagagagagagaggaaaggaaaggaaaggaaaggaaaggaaaggaaaggaaaggaaaggaaaggaaaggaaaggaaaggaaaggaaaggaaaggaaaggaaaggaaagaaaagaaaagaaaaagttaactgcactgtggttgattgggtaatatcaataaagcttatggctctcttcccaaatccctccttcctctctttctcccgctgggtttctttaagcaagaggaggcggggtgtccatgcaggtgggcgtggtctcattccagccaggccagagcaagctctccggtcagatctactgggcccaacttgcacctgcacatacacctccttgattgccctctccctaccttgagcttgccctttctgaagccatcatgtctgtgaccaagagtgccaggagtccgcaggtagccacccctctcaatctggaccttcctgagagtgccaagaagctgcagagccaggatcccagtccagcgaatgggagctcttcagagtcatcaaagaagaccaagggcataacgtgagtgcagctccctcccaccccacgtctgcctccatcagcttccagtccggatctcgaggtgggcatgtctgaccctcaacccactgtgcagctgggaacaccaaagaggaaaaagtgcagtcagggtctgtgtcaaataggacgttctagctaggggcacgattagaatctgaaaagtcctgagagggaaactgagacccagctgctttaagccacatgctaagatttattggaaggaagggggctaagcacttttgttaaagtcagtttggggctctcagtgtctaggagggaggcagaacttggagggaagctggggtcagtatgtaaaccacagtggcctcagccacaagcaacaagcaagcctctccctgtcgcaagcctgggtcctgctgccgctggggctgccatggtactacttcaaaagaacagcacgtggaagcttctagtgtcttccatttcccagaagatggattctagaggagacattcgcaaagatttttcagaacacgacaagctacagggctccaataccctcctcctcctcctcttcttcttcttcctcctccctacttgacttcactaacatagcagtctagccagcccaggctcgtgctttaaggagcaaggttgacgtcatcaaggtagtagggagtgtaattaacagaggaccagaaggtctgggttcaagtggaagccctgtccttctcttccctgaagcaagtgtcctcatatggaaagcagggaggagcacataccacctattatattaaaggatggacagacagacagagtggggaatgtgtggcagagagggagaaggtgctgaaggaatgggtacagtctctctccacaatctagaagagagctggaaatttaagattcattggagagaaagtcccaacttggaattgtctcccctaatgcccttgtcctttagatcaacttcacatctgttctaaactaaatagtaaattgaggctggaatatagcacagttggtaaagcgcctgttggatggcacactgccctgggtttgatccccagcacggtataaactgggcatggtgacatagctgtagtctcaacacttggggtatggaggtgggacaatcagaaattgaaggtaacccttggctacatagtgaatttgaggctagcctgtgctataggagatccagagaacaataagagaaaagtaggggaggatggaagagaaagagagagaagaaatcgtgagtgttgagggcaccgctcagaggcagagctcttgcctagcatgtacaaggtcccggctgtgaccctgagcaccataagccaacggcaacagaaagagtgggagtcctttgctttaacttgggttttattgggttagaggtcatgccattccccagacttaatgtcctgggctaagaagaaaagaaagaaagatctctctggagatcaatccccagatgaccgacatcacctgacctactgctgagaagtccccgggacttgtctccagtctgccttttcccctattctgggagtgcagtcctgtctctgccacagttcaggaagtcaaactggtctccgggcctcagtttcctttgtgatgatgtggggctgcccctttcctccctgtcctgggactgcctcccagggtcctgcagaagggcggagctacaaagcagcttggcttccagccacgactccactgtgcactcatagacaaattatctaagtattttggggcctccatttcccatctacagaccaaaccccaaccattgcctactttattgtcctgccaagacgattaaatgagatgttatatttaaagactccacgcatacagggtctcatacaattagtgtttcatggtacagacagggcccaagccgctaatggaacaattctggatatcttgggatgggtggtcaccttccaggagacccagatgtgccaaagcaaggatacaggaaaatcgagatggccatgaatttacctgcccacgcaggtaattgaagtgctggcacgctatgaggggatggctgctaggtcctttcccagctccatttccatgtcctctgactgccttcctttcctgtagcgggttccagacattggttcatctggtcaaaggcaacatgggcacagggatcctcggacttcccctggctgtgaagaatgcgggcatcttggtaagaggcatggctaagtgggggcactacgaagaagctgtgggatagggaagaagacataatggtttaaaataccttgtagcagtcagtgcttggggggtggagaggtatctgacccagacataaaatctgaacatcaagtctgagtctgagttctgccttggcttggcctctggcattaggagtcaagtcaacactttttatccaccctcaggcttcaaatccctccttttgtagaatgtaaggattagaggaggaccagttacccagtctacctttacagatgcccttggggacatctcagagaccaccaatgggccatgtgatcaggaccctgagtctcctgctccatcacaaatgtcaccgtgcttgctatgtgtactttttagacatgacttgaggttaactttcggaaagagtagccaagtctctttcaacttggttttctagaaagttctttcaggactagcaaatggctcacgagataaaggcactggccaccaagtccaatgacctgacaagctggaaaactgctcccttgctgctcccaaacacacacacacacatacacacacacacacacacacacacacagagagagagagagagagagagagagagagagagacagagagacagagagagacagagacagagagagagagagacctttgagtcctcagcagtatctgttcctctaagttgtcttctctcccacttactcctgtctgtctgtctgtcctgcctgcagatgggcccactcagcttgctggtaatgggcctcatcgcctgccactgtatgcacatcctagtcagatgtgcccagcgcttctgtcacaggtgaggaaggtcccctgtgtgggtcttgaggacagcccccaaacaccctacatattagaagagctttcttctttgtggtccccatgattgccaagaaaaagagcttcgggaatggggagacctcaggggatgcctggaaacaccgctgcttaaatgacctcaaccaggcctttgagctcatctggtcagcttgcctgtatagtgggtgtaaataactcttgcccatccctgcctctaaagggttatccccagttcagtgagagccatgggtctaggcactgctacacccacaccaggtctgtgctattactcatgctgtgtggtaactgctggaaccacaggtgagaacaaagccctgtggaattacagccccaattagaacctggctgtgctggcttcatgcctattccaccctctgtctgtgtggccttggtctggatctctggaccatgagttgtggggttccctgagtggatgtgtggggagtggaggaaactctgagcagatgtgtactttttgccatgagcacagcccggtcaagaattccaatgcccccgaagcctttccatcagagagatggcagtgctttcctctaatcctagggtgaatgtgggcagtgcatgcagcaactgtcagccacagcttcctcttctgggatggctgcagcctgaggcttctccctacagagccctcctacccctgctaggtagacttgcctcctggttcagctgtgtatgctaagccttcctcctcaagtcaggtgcatgggaactgggctgctgcagttcatgccctgcttcagagcaagaacggccccactggatcccaatttttcctggatatgtgtctgtctttttcctttcttcattccttcactaccccagttaggtcagtccctggaggggtgcagagcatgtcaggaagtgtgcgcatgtgtgcatatgtgtagacacatgccacaacacagtgtggaagtcagggggcagcctcagctgtctgtcctggccgtctaccttgtttgaagtctcttgttcactgtgcatgccaaggatacaacaggatgccagggatgcaggaagtctcctgtttctgcctttcatcttgatataatagtgtgtagacttcagaccagtgctactgtgcctggctttttatacacgttctgggatttgaactcaggtccttgtgtttacatggcatcaccccagcttgtcccctttgctctttaaaaacataatcttaggttaatctgtctcttaaaataccgtatgtgttttgtccaacagactgaacaagcctttcatggactatggggacacagtgatgcacggactggctttcagtcccaatgcctggctgcaaaaccacgcccactgggggaggtactttgctcttgctttgttcccagaggcttagggtatggagaaaaccatactgtctgggaaggtcttcttctctgacaaggtggctcagaggtcagactgtccaccccaggaggcaggtcactgccaacaacacctatccagttctcaagtatctctggtgacaaatggtcatttaccatacactcttaggaaaccacacttacccattgtccattgggaaagacagcctagcactcgattatgcaatacccactgggatacacatgaaagaggttctggctactaccaactggatagagcagtgtcagggccaaaggtaggggtatgtgtcaggccagggtggctacactggactgactgagatgtcttctgcattaagtaaccttgaaggatgaggagttacttagggatgtcgaaggcggggcttgaaggatccttcaggaacggggcagagctgagggattggtgcaagccatgttggggttatgtgacaggttcatgctacagaaagactaagcagcatgaaggcggagtcagggtcgagagatagactgaggaaggaactagatgctcagtcacattgcgcattctactcactggcccatattgtatattttagaccctctctaagattttgttattttcttttttttaaaaaaagatttattcttattccttttagttatgtgtgttgggggtgagttgtgtgcatgtgggtacaagtgcctccaaataccggaagcactggatcctgtggggttagagttaacagctggttgtgatgtaggggctgggaacccaactcaggtcctctgcgaaggcagtgcccgctctcaaccattgcattttctctccagcccttttctgaagaccagcagaaaaccaagagagctcctaatcatgggactaagcacgcttgcattcttgagaggttcatttagcgtctgtgaggggaagagattataagggagcacagggcagacttggacagacagggggtctttagtgtaggcaaggtccattctgatggtgatggagaccaagactaagctgttgtcccaggaatgaagtaaattgtcttggtaagggattagctgaaagaaaaggaaagcattggggcattggggctggggagatggcttgttattggtcaaagcatttgttgtgcaagcgtgagaaccagagtccagatctccagaacccacataaatatcaatgagggtggtggtccatctgcaaatccaaactcagaaagaagagacaggggagtcccgagagcaagctggctggcaaggctagccatataagggggctctgggtttgactganagaccctacctcaataatgaactagatggacgagcaatggagttaaccggctgtgagtgtgtgatggctgttcccaaacagccgccgttacctccctcctctgccctctcgattgtagtagaaggatggaggtatttgtgcagggccactatccattggggtcagagggcagaatgactagaaatggatcagaaaagtcagcttcttttatagcaagtttgtctctcctccttcctccaggcgtgtcgtgagcttcttcctcatcgtcacccagctgggtttctgctgtgtgtacattgtgtttctggcggacaatttaaaacaggtaagcaagccaaggtagggggaggacacacaaggaagcttctctaccagttgtttgcttggcaccttacttcatctgagtcctcagaaattcatcatgggaagggaaagccatgctattaggtagcttggcctcccccaccttccgtgtatctacagatttctgagtgtgtacatgtgtgtttatgtgtgtgtgtgagtgagtgtgkbctgcagaggacctaggtttcattcccaccactcacatgacagctcgatagctgtctgtgtctgttaattccagtccctggggactgacttctgacctcaccaggcaccagacgtacacatggaacacaaacatgcaaaacactcatacacacaaaatgataatgtaaataatctaatatttttgtttttaaaaagaggtaacaactctctaggccagttacactgcaataactgatggaacttaggggttataagtgaaagaaaggaactctgggaaaattttagggtggaaaataaatgtactggaatgatggaagctgacttataaaatggaagagaaagctaaaaggtggtgtccgaaaaggccagagcagtctctgtgtgtgtgtgtgtgtctgtgtgtctgtgtgtgtgtctgtgtctgtgtatctgtgtgtgtctgtgtatctgtgtgtgtctgtgtatttgtgtgtgtctgtgtgtgtacgtctgtgtgtaaacagtagagtgagtgagtcaccccttgggacctcactgtcagggtcactttcaccagttttagttggtctttgtgtcacttggcctgtctttgaattcactgcattggtagcctcctttgaggaagtctggtgaagagcatttagaataaggcatttcatgggctggagagatggcactgacagccaagcccgatgacctgagttccagccccagggcccacacagtggaagaagagaaccaactcctctaagttttcttctgactgcctcacatttcatgggctggagagatggcactgacagccaagcccgatgacctgagttccagccccagggcccacacagtggaagaagagaaccaactcctctaagttttcttctgactgcctcatgtgggtcatgtgagcacatatgcacacacacacacacacatacatgtttgtgtgtgtgcatatataatttaaatgtctttaaaaattaaaaccaaaaagaagttctcaagtaccctgtacttgctcgagctcccccgactctttgtaagagagtctggttctggggaaagccctagatccaccatgcgcccggatgtttttttccacctcatcttttcccattccttcctcaggtagtagaagctgttaacagcacaaccatcagctgccacaagaacgagacggtagttctgacgcccaccatggactctcgactctacatgctctccttcctgcccgttctggggcttctggtgttcgtcaggaacctgcgtgtcctcaccatcttctccctgctggccaacatcagcatgctggtcagcctggtcatcattgcccagtacatcatccaggtgggcacacaccacccactgactccccaggacacaggacccttgtatcaataatagacagcaggggccaagtcctaaatgggtgggtttgttcctcacccttgagcctaggacccatctccccatcttgctgtaacctcccctctttgtactgtctcctcttttgagctatctccttcctgctatgtctccaaatgacactttttaataccaaattcagctcttaaaaaggctctgtctgtggagttggggaggcaactccattagtaaaccgtttgccagtacctgtgctgtggcacatgcttataattccagcactggggtgggggaattagagtgagcagagcagagatagggtgattcctgtcagtctagtcaagttgataggatccggtttagtgagagacgctaacaaaaaataaagcagagagggataattaaagacacttaaattgacatctggcctccacatgcacccagatatgtacacttacacctgtacacacgcaagcgcgtgcacacacacacacaaacacacacgcacgcacgcacaaggacttctaacactcatgcccactattcattcataatgttcttgggtgctgctaggtggcacaagcctgtgccaccactgtgtatatatgctatagatagtgttcttttagagacttctggtaaacctgctccctttatgagaaactgaccttcggtgctttgacaatgcctgcatgttcctgccctctggctctttggtactgtgcactgttaaagtcaatatttatcagttttacctcattctaaaaggcttgctgaactttttggcattccattttctcaaatccagctctcctcccagagtccctcctgctcggaggagctcgagcatgcccacagagtgacaatcacgtatttttctcccctgtaggaaattccagatgccagccagttgccactggtagcaagctggaagacctacccgctcttctttggaacagccattttttcatttgaaagcatcggtgtggtaaggtttgaatgaaggtggcctttcctggggcctgtgaaccggcctctgggaaagagctatgagctcagactttctgtgtgctcttggccattggctcaggtctgtgggaattacacatgggataaaagcaacctctgctctcacttggatgacttgtctccagcaaacaaagagtaggttacaacagagaggcaatcgagaggctattttgtctcaaatgtgtctctttcatgtttatcttcctagcaatatgaggttcctaacctttgtaaaatcaagactagtggttgtacataattcagtgaaaagacttcataaacaatataggtgagggtctggaaggggttgtttgtttggttttggttttattgtagtggtggtttgcttgtttgggggtaggggttgtttttttgaaacagagtttctctgtgtaatcctggctatcctggaactctctatattcaccaggctagcctccagcccagagatctgcctgcccctgcctctgtctcccaactactggaactaaaggtgtatgttaccactgcctggcaagatacgggtgttttaaatggaaaagagctgtgcatttacaatgaattatgagctggggatatagctcagttggtagagtgctcacccagcatatacaaagacctaagttccatcctcagcaccccattaactgatttgatgaagcaagcctgtaatcccagccctcaggagggggaagtgggagaatcaggagttcaaggtcaccctcagctccacagcatagtcacagctagtctgaactacctgagaccctgtctcaaaaaaagaaaagaaaagaaaaaaaaaagaggcaatttctttcctctgatattgaagtgaagaacacacaacaatatcatcaagatgagcatcttctcagcccaatgacatcactctaatcctgcatcccaagctcagctcgctgcagcccaagctcagctcgntgcaagaacagccactcaggcccccccccccacagttcacccactgaagagtccctgaattgtctctagtctttaacagctactttactctaagcacttgtatacagatctctgtggatttaacttttttccctagaagaggcttctgggcctcatatttataggtgtttataaggaactatccaatggttttcagaatgacagtcattctgtctggatattgtttgtcattgctctgagtgctgggggactgaaaccagagtccagccctttaggcaaatgatcctaccactgaactccactcccagccttgactggcacttttcacaagaccagaacgtgtaagcattccctcccttctgtatctgggttagtgcttgtttgaattgtcagttcagaacatgcagggaattggacctaggacctcatataggctaagcatgcgtaattgaaccgtgccccagccccaagatattttttgaagatttgtttgtttgtttgtttgtttattatatgtgagtgcactgtagctgtcttcagacactccagaagagggcatcagatttttgtaatggatggttgtgagccaccatgtggttgctgggatttgaattcgtgtataaaaaaaggtaaactggtactgtagccccgattgggggnaanactaaggcatatctaccgccctcttctggccttttacagcactgcaatgtgtgtcagactctccttaaaacagatgtatttatttttatgctctgtcttttgcctgtgtgtctggtgcctgaagaggtcagaggagcgtgctgagtcacctggagctggagttacaggtagttgtgagctgcctggtgtgggtggtgggaactgaatcagagtcttctacaagaacaaccatcagggctcttaaytgytgagctacctctccagccccagaatttccttctttttaaaggctgtataatattccatttcaggtatgtaccacattttgtttacccattttatgatgtttgtctgcctcccacctcttgatcatgaatgatggtgacatgaacaagaacgtacaaatgtcttttaaggtcccttcttttgattcatttgggcacattccagaggcagcaaggctttctcttctttatgctcctggttgttactgttattgttgttgctgttgttatcctcttccttacagtgggatgctcctgcaggtcctgcctctggaaaacaagatgaaggatgcccgcggcttcccaaccattctgtctttggggatgtccatcatcaccaccctgtacattgctatcggggctctgggctacctgcggnttggagatgacatcaaagccagcatcactctcccgtaaggtatgaacagcttacgttttcgagctcggtaccccaccctccacttagaccctggccccttaccagccaaggtttctgggagaagtacgtagtctccacgtctgtcctcaggcctgccctgaaaagcaccagagcctgaatccctgatgatgcttctcttccctctacactggtgagatgcctctgcactcagagaaggcaccacaccttcattttcagataaggaaacaaagacccaagggattgtcccaacatcagagtctgctgcccccaggaggtcaggcgtggaagtgttgggccatggagaacatggctgtgtgtcttgcaggctgtaccaatcagtcaagctcctgtatgtcgtcggtatcctgtgtacctatgccctgcagttctacgtccctgcggaaatcatcatcccccttgctgtctctcaggtgtcaaaacgctgggcactgcccgtggacctgtctatccggcttgccctggtctgcctcacatgtgagtagaacagaggccgggagtctctggaccatttctggggaagagacagacagacagacagacaggcaggcaggcaggcagacacagtcagagacagagatctctcttgtgtgtgtgtctgtctgtctgtctgtcatctgtntgtctggtctggtctgttctgtantggtgnatcatcananatggcancctgtaaaaaccananncnattaggggagttttttntnncncngagcgagcttacnaacaaggtaacttttaaaacaatcctcctggtacctgtggaaaccgccatcttgtttttgtcatttatctgctaatttcctgccttgagtggagctatgcaaaaagcaaccactaggcggcagcaatagccagcttttggcagaaggtagtctctgcccgctgaggcttttggttatttccttttcctgaccatgatggggaacactgtgctcaaggcagcatcaagatggagggggccagggccagtcacaatgctcagataaaatgtcaccatctatgttacagataagtgtgttgaactttctaaaccactaagtcttagcccaactcagaaatccagcagtgnaacaannaaaaacatakgkkyatkcctatgggccaggggcagcagacagagacatcattggagtcgtttttttacttctgaattcttgcaatgaacatcttctgttacctgtcgggcaccaagcataatacagggctcttatataatagtttgggtaaaggtgttataaaaacaagagcttatataacattgtagctttgtgtacccaacagtagagtctacgggtcatctcctgagtcttgaccttgtaacttgccatggtcaacagtaaaagtgttacaaatggaaattcgatgatggcttccaccctgagactgccttctctttctgctttgtggagctgatttttctttaaagtgtgtgtgtgtgcatgtgtgtgcaccagacagaa

SEQ ID NO: 8 - DNA, 13894 bp, Mus musculus
  misc_feature (1736)..(1736): n is a, c, g, or t
aattctaccatcaggcttagctgcacgatttattttttaaaagtgcaaacttgtgattataaaccagtaaatgcacgttaatatatgctgaacaaataaattttagcaaggctaaaaattacggatattttgcatgccgacttccctggagactgcctcaaaatctaggtcgtctgccttagctctgtggtggtctcagaagcactgccctttctgaagcagcggctgacggccgccaggtggcgctgcagaacaagggtccgggaggaggagcacggaatggagcggcacgtgacctgggctagggagccagcatcacgtgacagggcccggaagcggctgtccaggaggctagaaaaccatggctaggggtcggcgctgaggctacgcgaggtgggctgagcaggagcgggagccagagccggagccggagccggagcgggagcccgggccgggcagggccgaccggtgagtagtgcgtgccctgcgctgcagtcgggagtcacctcctgctgtagcacctcccgccaaacggatgctgctgctcagggacaggtcacccgtgggggtggggtctcccatgcacctttgacaggtgttcagtcatagttcccaggtgacatcggcagtcactgacggctagctcggaccaacccttcgtttgcagatgtggctgttcgagctatgcccttgccttgggtcacagggtaccagaccgcaactcctttcctccgagagtaggggaaactgaggtccagggctgtgtgtgggcttgggctgagctcatggtggaaaagaatgtgttttgtttagttttggttttgggttttttttttttttttttatggtttgggaccctgtgaagttgaagtagaattgggtgacccagagaggatttcatgagtataactgtgccctctgctgaaggtagaggataaaaatagacacttcaagaatcatctgggttcatgtctcctgataatagctcactgataggtgatttaactactgtttgaggtccaagagataataagctcagaggagggtgggggtgaactcaaccagaagactagggaaggcttcctggaagtgtacacttgcactaccctgccctacccagaattacttcacacgtgtgttgcccaggtgccctggaatgaatttagaaatttatgagcagggcacccagtgggaaggtggggaggcagagggtgagcaggcccagcctgcccgtggacttcgtgcctcttgcatcctccttgactggtactgggcactctagtcagactcactccatagtacatctgtcaccgggagcagctgtgacaatgtctgcctctgtttctgagcccactccacaattggagctgaaggccccatctactggagatcttagcactgcctctgttcccccagctaccatgtccacacagaggcttcggaacgaagactatcatgactacagttccacagacgtgagccccgaggagagcccatctgaaggccttggcagcttctcccccggctcctaccaacgcttaggagagaacagtagcatgacgtgagtatttgtgaccttctgccatggagtgggctttcctgtccccaagtctcccttggaacaactggtgcctccaccttcccattttacactctgcttgacagaggaaagtaggctatccataggcagggccagcaagggactctgcccctccctagtcattgcttatttcttngttagttcccaaaggctggtgaagagcttgtacttaaaatctgcgtgagaaataatgtcttgggcaagaaccaagtgtcagatgcctcctggccccattagcgcctccttggcagagcctcctgggactccaatcccggcacttggcgggagggagtggcagctgtatttaagaaccctccagagttggtagaagagagatccactttccttaagggggctgcagtcttgtacctggcacctgaaaccccagtctcatctgggccacgtttggctctctggttcacagtttctcctgatataagaaccagttgagaagcctactgggaaactgggctggctgtgtgaggaaacttcagaggatggggttctgttctgagtttcccagcatgcccctggcctttgtcaaggtcccaggtccctgtccttggcggtcctatcatttatccccaatctcagctgtcatccttctagtgtcccttgtggctgggtgtgacttactgaggatggctctgtgtcttagtgcctcatgcctctacgctccatgactgcttaaagagactgtggcagctcaaggggatgttggggtggggtaccgagctgcatgatagaaaggtccctgaagacagcagcagcaccagtgggttaaggaaacagactgtggaggctcagcttccacgcagcagcatctcattttggagcagtgtcagaagaactgtcacggttgaagaggcgtttaagatgtcccttccttttccggctgtacgactagggagaacacagtctctcctagactcgctccaaagcaacgcgacatatagacattgaaacagacacccagctgtcttctgtcagatgagacgtttaggagatattttaaacagccgtgggggacgtgatgctggaacgctggctcagtggttaagagcattcgctgcccttgcagagggcctgagttctggtctcagcacccacagtgggctgttcacagctacctgtaactccagctttaggggatcccataccctttcctggtatttgagggcaccctcactcatgcacacgtgcacacacacagacatattttttttttaaacgaggggccggagatctagatgattgctgttcttccagaggacccagctttggtactcggcatccacatgatggctcaaccgtccataactccagtcagtcccaggcaacctgacactctcttctgacctccgagagcactccacagttactgcacagtacagatgagcgggcaggtcctagaacagaagggatggtcatgccaaatgacagtagtcagggccaggaagcccagcacagaggcattctgggggaggtttcagagaagtgggagggtgtggtacagatttacctttgcactgaagtgggttaaacatttgtttgacaagatagagatttaacaggcccgttatctcctggccactagctgcctgtaatgcctttggactgtgtggcctcagagttgcacaagggagcacatctctcctgggaggcaaaggccttttcctgatggtaggtgccagaatggcaggtagataccaggatggcaggtaaatcagatctccttcctggtggacctgagggaagggcctttgtgggccgcaagtgttgtgggcgtttgacttctgccaaatgtagatttgcatgcaagtgccagtcttgagggatctttgtgcgcagggtcaagtcctgagtgaccgaaggctgagtgacgagctgtttcgtactctgtcacgggcagcagctggcacactcctgtgtaatctgggatgtctgccttccctagagaagggggacttgtgactcacccttgctgtcaccacaacccatgtgtcactaaggcacagcattcctgtgtgatcctgatttctcagcagggtctgtggcttctcacctgtggtgtttacccacctccacttccctggctggcctcaggtctctgccttccactcacctgccccaactctccctggctctgtccccagcccctccatctttagttttcctccagatattatgtatctttagaagctggcatccatagtgactcacccatacccactgtgtagagctgcatatagtgtttgttaagtgaaaaaactcaacgaatgagaacccaagagagggtttatgtacgtcacagcacagtggggcaggctatacaaagtcagagggacaccggctcttcagacacaggggtaacccaggggcccactgaacagccatctctagcctgggtccacagtagcagttggcttctgctttttcaaagtctaataggaactttgtgttattgttttgagacgagacttgggagagaggttttggttgttcttgagctcattctgtagaccttgaactcagagatcctcctgcttccacctcccaagggctgggattaaaggtgagaatcaccatgccggtcccaataggaaggttgagtctcttgtattatgtgactgactcttagaggattatctagtgagtctgaaacaaacaaacaaacaacaaaacacaaccccccccccccccagcaaatacaaataaaacagagtgctccttgagcaggttggtcccttatctttgaaacaaaacagcaccaggttgctgggagatctgataaggtaatgtacctaagctctttgtgttggtgccatgcggataagcgatggccgggcttgcggttaaccattcccacttgcctccctactcagatggttccagaccctgatccacctgctgaaaggcaacattggcaccggactgctggggctgcctctggcagtgaagaacgcaggcctcctggtaagggtttcagacgtgcactcatcaaatgctgtgcatcactctccgagtgccaggcactgcataggctctgagcctggctcagtgacgttagctgacagtcctgccctccctttgactcacccacgtaacctgctcgcccagtgtcaccacggtttcagagacattgactgtccaagtgctgacctcgctgatcgccctcaagattacttcccggcctgcttcatcccggagcctgcccctctggatccaagacaatcccagaaggagcttatcttaggtcactgttttccacaagattcaacgtctggaccagggctgaggtcccatgtagatccagtctcttggattcctgctctctcctgatggacagagctctgttcctagaagtgccttaatcgcatttatcatctgtacatctcgtctcctttggcctctctcctaattctgccttcttctctcccttttgtctgcaacccagttgggtcctctcagcctgctggtgattggtatcgtggccgtgcactgcatgggtatcctggtgaagtgtgctcatcacttatgtcgtaggtgagagccccgagccacttgatgaggggtggaggttgtcagcgtgggcccttcagtctgaaagtgggttggacagctcgtctgggctctccacccagctgggaatggctgctgtcattacagtgttgtgtcccttccttattactgagattttgaccttttggggggttccttgctatctcttaagtttacagctgtccagcgggtggagactacagtctatgcttgtggattttggtgtcgattctgtgctgttcacttagtacctgtgacccaggggttggaagagggctcatttggtaaaatgttcaatgtgcaggcttcggcatctgttaacaaaagaagctggtgcggaggagctcctgcagtccctgcatgggaaaggcagaggcwggaagtcccggaggctttcccgacacccattctagcacagtaggcaagctgtggttcagtaagaggtcctatcttgagagagtgattgggggaaaacacccgatatccactctagcctccatgtatgtgaacctgtacacctataaacatatatacacatacatacatgcaccccacttatggtcttcaaggggttcagagttcccctagggtgacaggtggagaattggtccatatcttaatagctccatttgtctttttactgtcatggtctaacccaggcattctgcttctcttgtatcctaaccccgcagactgaacaaaccctttttggactatggggacacggtgatgtatggactagaatgcagccccagcacctgggtccggaaccactcccactggggaaggtaactgacttccttgtttctatggccacagctcccagtgtggggaccagagataggcaggtatgatgcagggcattgtgaggagcggagggtattgttggggttagccacgaggcctcagcttcctcatctttaatatgtgggacctgacctaaggacctctgaaggctgtgtcggccctcagagcctgcggctgctctggtatgttcagcaaatgtgttttatgtggtctcttgtaagcggcacaaaaatgattcctgcttagagaaggcatttccctaatataaattacttagtccctaccctgcaggggcttatggcttttgtagggtgatagatgcgtgggaagagaagcctggaacaagacaagagacgcatggttaaggggccgcagggccgatcttgatgcctgggtatggggtaggcaaggcagtgtccggagcaggtggggagctttggaggtttctcctgacttttcaggtgactggagggaaacagtccaccctttgttcctgtctacatggaggggataagtactgtcgagggcctgaatcctcagttctcttgttttgatgaagagggtgcttgctgtcatttgtggctccagcctataatgtggtgtgtcccttcttttctccctcctctctccctgcctcccttctcctttcttcttggcaaaatcacctgttgatgagcagtcaggttgcagagtgcccaccacagtttggctaatcagccagttcttcctgtctgcgttccttcctccccctctctctctgttctcccgcacacccttcctggtgttcataggaagagcattgtttgcacatggtaagaaaaacagtattaacttctagccatagtgcagtggcatgggggcatcctttgggttctcctggaacttcctgtgcacgtatgagcatacacatcttcttacatttctctctctctcttgttggccaatggctcttcctgtgtgtgctgtttagaagcttgctttctctcctttgataccttggagattttcctccggaagtggttgcagctctaacccatcctttctcactgctgtgccttgttccgtttaagacaggtctggaaccccgttgctctcaccggggcttcagatcgtcacccactgttgtcacagtgcttctgccaggagaccttcaactacatcagtgcttggctcgcagttgtaggagttggagaaaggcctgctttctagacttttatgctttagcaaagaattgagtttggtgggtggacagtagaaggcatgggccaggttatgctctggtgatgccctgagctcatgcagagaggcaacaaccagggaggggacgtggagagcacagatactcccaaaactctgcaccggtggccctggcacaccttgccttcttgccacagcttgttcttgtcacccactgagaagggacagcgaggacagctgtgcagatgctcatctccggggaagcttccagacctgacgggctttgcccctgtctcaccctctctgcaggcgcatcgtggacttcttcctcatcgtcactcagctgggattctgctgtgtctacttcgtgtttctggcggacaactttaagcaggtagagttcttgagagagagggaagggtgagagtgggcggggcttttgtccgaggctctgggctgaacctttggtgtttgattctcatcccagcacctgtggtgtaaagagctcctgccttgcctgtgttgacaccagctgatctcccctctgtagaccatttatgttactgaatgaaagacactcacagcctttacattataatatgccttaggcagcacgatagctgggtagctgcctaccctccatgctgttaagagtctaccttcactaactccgttatcatttactattgactgtgtcccatctgggctgctcttaacccaattggcggctctcctccctctgctcatttttcctttattccttggctgcttcttcctaccttctccctcctcagctccacccccccccacaagcctgcaaaacctcaaccccacctatgtctcttctgcccagctattagccgtcagcatctttattcaccaatcacaattaacctgggggcgggtcaccggggcggactccaggtcttggggccccacatgtagcattacggtagacaggagaagaagctcctcccaggctggtctggggagcttctgtgttcctgggcagctttcgggacctttacctaagtacaagtgcacagctctgtggaggcctcagagtcggttgtcattttctatggctactgggcaggcttaggtgtcaggctgcctcagcctttgacagaagccagggttatatcacccttgtctaaaaaggctatagatttagggccagagcctatgccctagatccctaataagccaggtacagccacccgtccttggtaagtaagggttgataatgaagagcagaaaaagacttatcagtataacctcacggggaggaaggatctgtggatccaccaagtgcgtcttcgggggcctgacaggaggcgaagtttaaatagaaggaaagagataggtggtcaaggtgtggtcctgcccgtcacggcccatcactgtctccactccagtctctcctgctcggtggcactgtgtataatcccatcccctttccaggagactagttctgtgccacggccatttccttctctcggcatggtattcctagggggaattccacgtgtctagggtgccagagtccagatggctggaaggaggaacttagtgtttcttcagaatgccccccttcatttcagtcatcccagttatagctgggtcagggcctgcaggcttttctctttgcttcctgaacatcagaaatgcttaagataagggtgggaagagcttaccgttaaattcccccatcatctgtctcccacgtccttctgtcttgtgaaacatcatcaaacccagctcagacaatttgcaaccatgaaaactccagaggtgcctacatataacaccaatttcagacagcggatcctttttccagaccctctctagcaagataacccactggctccatcactcagggcttcttctccttccttctggttccaggtgatagaggcagccaatgggaccaccaccaactgcaacaacaatgtgaccgtgatcccgacgcccaccatggactctcgactctacatgctctccttcctgcccttcctggtgttgctgtctttcatcaggaacctgcgtgtgttgtccatcttctccctgctggccaacatcagcatgttcgtcagcctgatcatgatataccagttcattgtccaggtacaagcccaggctgccccatctgtggaataggaaatcaaatggaaggatcacagcactgcccacatgcggcgtatttagattagaggttgcatcgtttcctgaggagatgggaacaacgtttacttcagagaggcctccagtgcagaccagaaattactccacttagatctttccatttatgtattttataacatttttctcaagcttttaattcattggtcttgttgtagagttgagctgggttgataatttgcaagcttctttgtacagggaactctctccacttcgttggttgagttgcaggccagcatggtcagcgtcacttacttgatggatgggatgtcggctaacctgtctcagtcacagagcagccgtttctgtgatctgtgaaactcccacttacagctccatctgactgatagatgaacctgggatctgtcagtcactgacccatgggtagctcctgtttctagtgtcatctgtgactcacgaatagttactgcgtggacttgagacacctatttgtcctcatcctgtaacctaaaatgcttcttctttttttaagagtaaaatttttaaaattaattatgcatatatgtgtgggtatgtgtgcatgaggacaggagccatgaagactacatgagggtgtctgatccccctgcagtcatgtaacagtatgggaatttagtcttctgcaagagcagtgtgtgttcctaacagccgagctgccccaccctaggctctgactttcatgcttcaattatattcattttgctaccttccctcagcgtttctcggcattcttctcatgtgcctcttgataaagtgctcagtttcttttatctcttgagtttcttttatatcaaatgtctggggatgctatcaccgagtgcaagagcatgaagctttatgcaggcatcagcatgtgagaggtttatggtatattgggcagatctttatccaaaacaagtagagacttcccaacccaaggagagaaaaaggccgactgtctccatcttatctgtcagcttcttcttatttggaagtcttggatttaggagaagttgtgctctgactggtgctccaaagctcaaatctctaaatagcccttggctttgttcatcttttccagaggatcccagaccccagccacctccccttggtggctccatggaagacctaccctctgttctttggcacagcgatttttgcttttgaaggcattggagtggtaagaagggtactgtggcttgggcctgagtgctccctgtggacctgagtgcttcctgccacccatgtcctcactgactctgctttagtgctcgggaaccccaacatgggctgtcccatggtcacacacttaggagtgggtagggtgatcccggtctggctgtcctggctcagttaatttaagcccccagtatataaatcttccaccccccccccaaaccattaagaaggaattcaccttggaaatggcggaggtgaattcaaacaggtcagaatctctggggcctctgtaaaggtaaggcctccattctgcaactgcgaaaaaggaatcatccccttctcttggttaacggtataaacccctctccctctgtggtggaaaacccagtgttatttttgtcatgtgttcacgtctttctcacatgctctccttcccttactacttttttgtaggttctaccccttgagaacaaaatgaaggactcacagaaatttccattgattctgtatttggggatggctatcatcactgtactctacatcagcctggggagcctggggtacctgcaatttggagctaatatcaagggcagcatcaccctcaacctgcccaactgctggtatgtggagggactggaaacttccagaaggcgacaggtcacgatgtggctttttcttgtcacttggctaccctgagcttgtgatcttacagcagcttgtactgaatttatgtgtgaatcttgcacctgttaagacatttctcctgtgaaatactaagcccagaagggctgagtatccagtgtgtgtgtgcctaaagccattccagactcgtgtgattggaggggaggtctgcctggtcagtcacaggtgtgccatgcaagtgaaaaagttctcctgtagttctcctgtagctggtctgaaattcagtatgtagcagaggctgaccttgaactcttcccgtctccctctccagagtgctagtgttatgctgtgcctggctcatgtcttcattgtgaagagctacacaggggcactgagacttatttagctagttttctatgaattaacatttcatttttgtagccttcccttgcataaaagctatggagaactttttctttttaattaatttgcattgtgtgtgtgtgagtgagtgggagatctcttcagagagagagagagagagagagagagagagagagagagagagagagagagagagagagagagagaaattggggcagggggaagagagagagccagcataagacttatcagtctgaagactgtgcgggtgggttggtgatctttccggctgtctccagggtacaggggcgggtttgggctctgtcagggctgtcggagtgcaccatcagtctcctgagagcacccactctctgcaggttgtaccagtcggtgaagctgctgtactccataggcatcttcttcacctatgccctccagttctatgtcgcagctgagatcatcatcccggccattgtgtcccgagtgcctgagcatttcgagctgatggtggacctttgtgtgcgcaccgccatggtctgtgtgacatgtgagtagaagagattatttctgcatttccttaaaggttagaggacatctggattgtccccagtgagagcctggcacacagacacgctactaacgtccctttctctctgcaggtgtgctggccatcctcatcccacgcctggacctggtcatctccctggtgggctctgtgagcagcagcgccctggccctcatcatcccgcccctgctggaggtggtcacctactatggagagggcattagccccctgaccttttccaaggatgccctcatcatcatcctgggcttcgtgggcttcgtggtggggacctacgagtctctgtgtgagctgatccagccaagccatagcgactcctctaccaattccaccagtgccttcatataaggatctgggtgtgctccctccaccagcctcaccctgtgtgtctcccagtagtgtccccacatcctcaggtatagtccagcctctggaaaaaggcagggttgctgcctgggcactgctctatctggcattggacccttgggtaacctgggctagatgagactgagactgggggagggcggggagcagcccctccacttgtgatggtgccgtcgctgctctccttcatcacgcctcctccctcgggaaccagacagagtggtcggacgtggcaatcaggagggtggcgccaagctggcttgagaatttaattttccaaagtacattacaaatcagataccattaggggaaagcgggccatgtggctcatctttgaaactgtggtcaatacttgaaggcactttagtcctgctggccgcgccagcttccgtmtggccggtgtcttctttttctgtgtgtcccgagccattcamtggtcagagacattaaaccgtgctcataagcagttatcaaaaaaaagcagcagaaaatgaggctggaaggagcctggtgtttaccctgttctttggtttaaatcaagccgatgttgaagaagctggaattttttttttatgaataataaaatcccacgtctatatcgtaaagctgtcagtatatgttgaaatcaaggaacgagagaactgccctacagagagtcttaacagccagacagtaccgtgtgctggcgcctacctggatgtgcattgcgtacacgcgtggggcatgtcagagcttcagatgtgcattgcgaacatgcatgggtcatgtcatagcttcagatgtgcattgtgtacatgtgtgggtcatgtcagagcttctaggtctcatttgggttgcacatatggatcttgtgttaaatttccacttcaataaatgaattttattttttatttttgagaggttgcaaactgtgtctttgttttcacacttcagggaaaaaaaatcactgagttaggacaatctgacaaagggacaggggtctgagaaagggaaagcaaccctgtttccctaaaccacttcgatattctcccgaaatcctgggtcgccttctgcatataccagtgggtagttttagggatcagcttggtttttcagtcaaatatgagcctgggtgtttgcaaatgttaacatttagagcagttgacaaagtaaagattacccttgctagtgtgggtggcttcatcacatccaaaagttcttaaaccgtggcctccctgaggaggaatcctatctccagaccacaagaccagcttctcagcttccacacttgagtggagaccagccctaggaactgtacacctgtcagccacagctaagctagttctcctttgaaatttgtttctatattctctctctctctctctctctctctacca

SEQ ID NO: 9 - DNA, 42619 bp, Homo sapiens
atgtttactttggctcattgaaactgatttagggctctggccttcagaactgtaagaacaaatttgtgtgttgttttatggcactaagtttgtggcaatttgttagagcagccataggaaaccaacacaggcaaaagaaaggacctctgaggcttactccacatctgtcaaatgggatcaataccacattcattcattgaatattttttgagagcctaccatgagccaggcctaagaactgggaaggtgaccaagtacttcccactttcatggagcttaaattctagtgggaggagataaacaacaatggggatacacacacataatcaagataattacaaattgtgagaagcaacatgaaaaaaagcaggggtatgactgagaataactagtcaagcagagggtcctcctttagatagagttgtcaagggaggttgttggagcagaaaaatcttgacctaagactagcataacaaaaagcagaggataaaaagtgcaggcacagagagcagcaaatgcagtatccaaggagggaaaggacaaaatttaatgcaggaaaaaaggtccatgtgactggagcatagtgttctagggagagacatgaacaaggtgagttgggagagaggcagcagctggatcatgcaggaccttgtgggttgtggtgaggaatactgatatgttctcaggtcaatttggagcaggaggaggtttcaggaaggggagttgcatcatcatttgctcttgtgaggaaatagattttaaacagggaagtggagaggccaggaaactagttaggaagctagttttccaagtgagggatgatgctggcttggatgagaatggaggtggtgaggatgaaggattgctctgaatactgtataacataaaatgcttaataaatggtagctctcgttacagtatgatgatgatgatgataactgtcattatcattattagcttttgctgaaaaaagaaacggataaatgaaactcagttgggtcataagagttgacacctgcaacaagtgagagaccccattcccgttcaccagaagaagccacttgctgatgccactgaccgctcctcatccccaattcactctccccagcaagttcagaaacctaaaaatgtgtcagagcctatacctacacacatgaatatgtgattaggccacttaggggttctcaggaatagcttttttttttttttgagacggagtttcactctttttgcccaggctggagcgcagtggtgcgatctcgtctcactgcaacagagcttgggaatcaaaagacctgggctgggttaaagtccctatctcaccactgtatccctgttcactcactgtgttccttctcctatctgggcctcagtttcccaatcggtgagacagtatgagtcaacgaaatgaccttgtaagttccctccaacaataaaatgatatcataaaaatggttctcctctctgggcactgactgtgactcaggcactgtacttgtttattttctcatgtaatcctcacgcctgcctaaagacacactcattagtattttacagttgagaaacaccaaagcacagagtggtggccatcagaaagggagcagtattgttagcattaaaaacattgtcctttaatcccagcactttgggaggccaaggcgggctcaggaattcaagaccagcctgggcaacatggcaaaaccccatcactacaaaaaatacaaaaattaggcatggtgtcatgcacctgtagtcctggctacttgggaggctgaggtgggaggatcacttgagcttgggaggtggaggttgcagtgagccgcgatcacaccattgcactccagcctgggcaatggagtgagactctgtttcaaaaaagccacaaaaaaccccattatcctttatcctgatattatgttcttccagctttagggggttgaaatattctctttttttttaatggtgatattttaaaggtttttaatggagagaaatgagaatttgcccatctatatcagtccctaacatttatttagaaatttgattgatgcatgaagtcccagtcttgaatggcataaagtatgcacaggaaagggttttcaactatttcagagttcctactacgccctagtcatagcagaggaacacagagataactcaactgcagcttcagaggcacatgccaagaggcctggaatccaatcaaagctctgcctctagtactaactgggtcaccttaggcaagggaggtaacccctctgagcctcagtttcctcatctgtaaaatgggggtaatcatagtgcctacctcatgtaacacacctcatctagagcttggcacatagaatagactcaatacatgtgagtcgctattatcattattatttagatgggggtagaaggagtcacattcatcagccacagactatgaggaggtacccggggccgggggagggtggtggtggtggtggtggtggtgaggatagggtgatgaattttcatccaggtaggggtttcattttgtctctgaagtctctgacttctagcccaaaggagtaccagtgatcatttctaccagattatacgacctcaggcaaatatttcccagctctctgccttggttctctaatctattaaaaaagaagcaattatttccactccatagaacagtggactcaaacttcagctagtatcagaatcacctgatgaacttggcaaaataacatggcacagattctatcctacttcaacaagtctgagtctctgttctttattatctcttcagatgctttgatacacaccacgttttaaaagtgccataagccatgaaaggaacaaggctctgtgtttactctaaaggatcataggagattattatcattatttacatcccatttgctccactctttttggagatgtctagtgggcaggctgtcttttcaccagttgcctgccccacccaagaaaagctggcctgcatctcagcgttaccaaacaccccatccaagcccttggggttctcatgcctttggaagtcatctacaatctagtatccatcttgcaaaggggacactggagtttgaaggggaataatatctttccaagggttgccacagcttcatagttagagccatagcggaacccagggcttcggatgcctgggccactcgtgttggaagggcttattttggacatccccaccctaggagaagacctcctgcctgctaacatgtggtgcaatgagttggggtgtggagccccaccctacaagcttttttttcactgacgatgcctgggaagagctctggccaaacactgatattccagccacccctttccaaaaggcctgaagataattcagagttcttctcaaaacctggagaggaaggcaagaactagctcatatctaaacatagcaagctcctcaacaatcttattactgaccttgctcgagcaggaacacagagctccacctgcgacatcaaatctgagattacaaatttaaattgtggaatctcaggctgtaaacgagcaggtcacaggatgcagcctgctacttcacagaccagtaatactgccatgtaatggtgccagacaagggaataacacttctcaaatcacagcaagtgtttcagttgattcaggacaagaagctggcagggtggggccagcattaaaacaaaggagacagtgctgtggtcaaagctgcaggcttcagaaaaaacaaacaaacaaaacaaaaaacaaacaacaacaaccaaaaaaaacctggctagcggggagttcggatttaccgagttccagctgtgacctccagcaagttattcttttcctctctgagcctcaatttccacatctgtaaaaacaaactaacaaagctaacccacagaagtagccaggctttgtggagcttgaagcttatcccatggagaaggggaaagtagtggtaaggaggacctctttaagaaaaaagcaatacaaaattgtccattcaaaattgcatacaggaccttggaaagagccccatgtaagggaggggcctgacaaatctgtcttggatgctaccagttagcagtgacattagctaagcaaagcttgtggcatgtaataagcccttaagaaatgttagttttggggatgagatgatggaggagagagtggtatggcttgagtcaaaagctgtaattttgagggaggaggaaattttggcctgttcatctgcactgaagcagagataatgacagagagtgggatactagagaaacgcccaagaccgtctttagctgcagagttctatcctggatttcatgtgtgaccttagacaaatctcaccacctcctggcgccagtatcttgcccagcaaactgtggctgggagtcatacaatctcagcctcttccccgtttccagaagaacactctttactcactccatggagcctcacaaaagctaagaattaattagagatgactgagtgactgtcccttttttgttccaatttaagaatggggtgctgcaagaagggatgtcttacagcagactgtggagccagtgagacatggaaacctctaccctgagatgaataaaaggagagggatttgtaggtattttcttggagacagaaataggttactggttgaaaaccttgacaaattgggctaggttccaactctgtcactttctagctatctgacctcgggcagattcctttacttcaagaaacctcagttttctccttacttaattgatagggttaaatgagaaaatgtagataaaacacttagaggattgcttatcccttagtacagggcttaatagatatttgttattaaaattatcagtataatagttatcattatgattattattaagtaataccaatacgaatgggtgatgccttttccaaatccctccttcctctcctcctcttcccaggagtcctcgtccactggcttctccaggcaggaagaggtgccctccagggaggtgggcggggcctcgttccagcttggccagagccagcccgggcacacaccactgtgctggggtgtacatctacactagacaccttcctgcttccctccttccagagcagacctctttgtcaccccgagctccttgtttcttaagcagtcatgtctgtgacaaaaagtactgagggtccccagggagccgttgccatcaaattggaccttatgtcgcctcctgaaagtgccaagaagttggagaacaaggactctacattcttggatgaaagtccttcagagtcagcaggcttgaagaagaccaagggcataacgtgagtgctgttttctgccatccctatttctgctttctagcctgaagcttgcattggcaaaaaccctgaggtgggtgtgtctgaccctcaacccactgtgcagatgagaaaccaaggttgcaaaaggtgcagtcatgggctgagtcaagctgaggcagaagtaaaggctgtcagaaaagcccttagggacatagtgatccagatcccaaaaggcacaggtggggaaactgaggctcaattaccctggaccacatactgagtcattggcaggataagggctagaattcagtgctggccctaaagccacatttttgttcctggccagcgatgttaagattggggatagaggtagaatccctaactacttggaggagaaggtgagtcctgagcttaaaaccacagtggcctcactgaccactaagtatttcctcctccctgcctccttcctgcagtaagcctggcctctacttcaactgagaagcatagatgactctaaaaaacacactttgtggaaagttctagttttttccactttccagggagtggggagtgggggttattcacaaggcttccaaaacataaaaaaagagggaagccaagctacagggctgcagctcccttccccacatctgaccccaccacccaaccagacttgctagtttacttaggaacaaaaggtgtggggtgtggtagtgaagaggttctgctgctttaagaagaaagtttttgcaccactagatagtagaaagagcactggacagagaatcagaaggcctgagttcaagtggtttctctgctccttctctaagttccagttttctgacatgcaaaacaggtggcagtgtgaactaaaggagggtgcatggaaacaaaatcggaggatgtgtttctcgggggtgcactgcagggagggactgtaaggggcaggcaaagcccctccccacagccatccagcaggacaatttagggatggacacagtgactggccctgctgcctgtgctgtcgccccagggctagtcctggaagttgctaagtattagtgaccctgagagtgtgctgtctgtaagttggggccagccactgctaagtagaggcattttctcagtcagaggccttgagggaaccacctgtctcttgtgtcctgaactgatacaaggtttgatggcaatttcagcaacttaaggatcaaaggaataaagcaagtgagagctaaagggagacacgtggcttggggagaagccaaataacgggctgagtaagcgtggcaacgatggggttggctcacccagactcgaattcccacttagctgcttaccagctagagcaaatgctggaacttctttgtgtccagtttctcctctgtcaatgatagttctctcctcctgggagatttgagcataaataccccagacacagtgtctgtaagtgttggctgctgtgaataagatgacagtccaaggtgaccaaaaagaaaggagttagagttggagcccatgtctcccaactcccagtttggtgctttgcatgacttaccgcactatgttttcaagttggttgagtggcccaaagttaaattctgatttcctaagtactttagttagaaatttccaaagtaacccgctgaccctttcctagttgcaaaacaagcccattgctagcctggcgagtagggtgtagtgctcggtcagcgatgtggacacccacagggagaaaggcatgcagggactctccaccccctttctccctcgattgttctctttaacccttgatgaatctatgtacagagactcaggaagctagagggtttacagcttcaatatgaagcttcctgagcctctgcccatagattcttttaaaatagcatcttttaaaaatagcatcactcctgacatttacagagggtcaacaaagttgaacacgttgcccaagatgacacagctagttaagtcgtggccttgaggtttaatccctggtttgtcaaatcccagagaccgggctcctttcagagtacctctgttgttttacaaagaataagtctcctaaccagaaggttctcatggggaatttccaaggtttctaaagttgcacgtgtaaaccccatgctcgccttgacttaacctggtacaggtacaaaaacgtgtagaaataggttgttttgtaattccgctaatagagtgcctccctggaacattttttctcctgatggtttagactttgtcctccgggcaaaccttcgcatttgtcttaaaggaagggtctgagtttttgtttgggggaggggaggtgtgcactctccagccttgatgccctgggctgagaaaagaaatccctctggagcccaatccctgaatggttatgccccgccagacctcatctggggacccagtcatccgacctgtttattcagaagtcacaatgattttttgtttctgcctgccctttccccttttctctgtgttcaagcctgtctctactactagttttatgacattgagctagtttctgcccctctctgagccttcatttcctcagttatgatatggggttgtttctttacttacgctgtctgagtttatctctgggaggcagctcagcagaagtaggggtgaagaacagggactctgaagcagcactgtgttaaatcttggctccccaatatatcctggataagtcattaacaaatctctgtgcctcagtttcttcacctgcaagatgataatcgtatctttgtcagagccttgactagaagattaaatgagataatactgatttaaagcacctagcacagtgtctcatatagtaagtgttgcagcatatattgagtgttagctgctaaaaccaggacagttctgggcaaactgggatggttggtaaccctacaggagacccagatgtgccaggcaaggactcatggactgagagatggctaggagcccgcctatcaggtgctggcatgctgcaagggaatcaccgctggatcttctcacctccacacacccatacttcacatctccttcctctcctttagagtgttccaggccttgattcacctggtgaaaggcaacatgggcacagggatcctgggactacccctcgctgtgaagaacgcgggcatcctggtaagagaggcgccacatgtgggggctttatggtcagttgcagaagggaagtaagaggagaggctctagcggtttagcaacctgtggtgagcagtctttctgggacacagcttggtgcggggttagggtctagacatctagcctgggtttgagttccggctctgccacagactttagtacctttggtaagtcatttgcctgctctatgggccttagtttcctcccctgtagaatgcaaggattggactatgcccagttttccaagtatgctctatagaacaccaggtccccttggggatgtttcaggggccacaaagggcacacatggtcaggattctctgtccccctactcccatcagtataccccattgtaattgctttatgtgctttattggaatattacttgaggtcatatttgaaagaatagctgttgctgctacaaaagggctttaaacccagtttgctagagagttctttgagttctgcatgatatcagcactaccaagcccatcttgcagtattcttcataaatgcattctcttctctcctccctcgccccttgcctccccttcctccagatgggcccactcagtctgctggtgatgggcttcattgcctgccactgtatgcacatcctggtcaagtgtgcccagcgcttctgtaagaggtgaggaaaacagcctccttgtgtcaattcctttggtgcatggttctcagggatagcccagaaacatcctatgcataatagaaatttacttcttagttttctccaataaggccaagaaagagtgaagagcattcaggggcagggagctcaggtgaggctcttctgcatggctccttaggagatctcagtcaggctattgtgcttatctggttggctcctctggaaattgggcataaactatgcagagaatggtcacgagaatccaatgggatcatggatatgaaaactaccgtccccgtgcaaggtgtgcattagactcttgctgtgtagtctccgcctcatttaacaggtaaggaaaacaagccactgaggaattactgctgagtgtcaaagcccgaggtctctgcccctgtgttctttctgctctttagctgtgtcctgccttgttctgtgtctcctgacttttgaccatgtgagtttaggctaaactatctcttggaaaccgtttatgcactctctcctgcaggcttaacaagccctttatggactatggggacacggtgatgcatggactagaagccaaccccaacgcctggctccagaatcacgctcactggggaaggtaacctgttcttgctttgcctgcagtggggtaggacacaggaggagaaaatgctgctatcagggtgacttcttccctggaaaggtggtttgtttggcacttctatgttagatgttgtacatggaaggggttcattggcaacatccctgatcaacccccacttcttgtgtatctctagtgacaggatactcattcctttgctacgcagctttaatgttttttactcttttattaaaccacatttatccagttactcctatggccctggacatgtcatggggactgagaagaacaagactttgccctcacagaacccatagtccagtgagaaaggcagacattaaacagcctagaatagagttatttaatagccgcttggatatgtacgatgaaggaaagaagggctggttgccaccaggcaggttaggagatgtgtgttggcttgggggagaggagggctttctaggatggaacgggtgagatgagttctgcaggaaggagtcctgaagaatgaggaatcacctcaaagaaggtggacaggggcctggagggtggggctggaaggaagagagggtgtgaaggtccctgaagcaagaaggtataggtgacagattcaaggtacaacaagaccaggtagcttgagggcagagagtcagggaggtggaactgaagaaggagccaggcacccaatcaagtggtacattttagaccctctgaaacgaagactctatttgttcttttcttaaaaccaaccaggaagccattggagggttttaatcaggaaagtcatcatatttgtattgtttaaagatctgtctggcttctctaaggagaatagattgtaagggagcaagagcagatttagtcagatccatgagggggctattaacagtacccagccaggtcacaatggtagctgggaccaagctggtggcagtgggatgaagaaaagttgacttgatcatgaactggatcctgggattgggagacaaggaagagtcgagattgactcagatttatgatcacttctattttggacaagttgagtttggggtgcctgagaaacatttaagtggagatgtctagtggggatatatgggtttaagcctatcttcatgcaccaatccagaactgaagtcatcagccatgaagccagggacagagaggtctcttagggagaggttatatggtgagaagaaaagagaggaaaagaccaagactttaagaaccctttgttgagctgagtgaagtcttgctccctgaaaaatcccaccttttagctctcaggggtgacagagaacaggttaacaccctttgtcctctggtacttgggactaaatctactcctttctccttgtttcagacctgtccccacctgtctgtctcctcttgttgagcaccatctagactgtcaaattctcttttgaactgtgcttccctaaactgctgcagtactcacggtgtgcccctgcccatggcaggtagtctgtatggtatcatgggcctggaaccacccttcgctcaaagcccatactcacaagagtaatccacaaattcagtctgtgaacagacaaggaagactactggataatgaccagaattttcccaattgtgtgacccaggaggagacttgcctgtcacagactgtcaaatccttctacttgttgttgggcatataaagaagatttccctgctccatttagggatcttctttcattaattactgcctctcctataactggaattcctttagtatgggttcttcctctcagcatttaatgtgttcctgtatctccagcaaaccaccatggcacatgtatacctaggtaacaaaagtgcacattctgcatatgtaccccagaacttaagatacaataataataataataaagcaagtaaataaaacttcctggaccttaccattgtagccaacatcctatctacattcaatatatattattcaacaaatgtctactgaatacctacaatgtgtcataaagtgctttagacaatgggtctactgcaacgagcaaatgggtgccatcaacactggaccaccctctgattttattgccttacatcccatccacacctctttcacaggccacctgggttttctgtccttataattctactgaagttctttcaagcaatgtcctaaaagaccttcttgttgtatcttccttgccctagagaacctttcagcagtaatgtgtataattgaccattctcttttttcaacattctctcctcacttggctactattaaacctctttccccctagtttccctcctacctttctagccactcctttgcatttgttgtaagcttttttgtttctattaaatgttgatgttctccagggttgaacactgtcttctactctcctcattctgcacactttctaacactgctctgcctttgcaaggctttatccactactacaactcaacagttccagaccctaatatccagttgtgtcccgaacgtctcctataggaacctcaagttcaaagattcagattctgaatgtgtcatttcttccccttctcctaaaactgtcctcctcctcctcctcgtcttcttcttcctcctcttcctcttctcttagttcttcttccacctcctcctcttcttccccctcctcctcctccccttcctcctcctctccctcctcctcctctcctcctcctccacctcttcctcctcctcctccttcctcttcttcctcctccttctcctcctcttcttcctcctccttctcctcctcttcttcctcctccttctcctctttttcctctcctcctttttcttctttttctctctctctttgtccctccctcttcctccccacaactctctttcttccctttcccaaggggctgtctcttaggtattgggttttctaacaaggctttctgtctgcccataatttagataaaatgcccttttcaccatggcccttaatgctatatctaagaatttttgtccacctaacccattagtctataaaccacaagaggaagggactgtatgttatttgtctgtgtattctcagtgcccaacatagttctggcacatggcagaaaaaaattcaaatgtgaatggtagctaataaaaacattgtgcctgctgtcccacattaattggtatcaatgatgaggaatgccaccaagcccggtatcgggagaggctcataaccaggaagaattttaccacttgctgagctgagagtgtgagggtggttaaaaatcatcttttaaaaagaactattgttggccgggcatggtggcttatgcctgtaatcccagcactttgggaggccaaggcaggcggatcacctgaggtcgggagatcgagatcagcctgaccaacatggagaaaccttgtctctaccaaaaatacaaaattagccaggcgtggtggcacatgcctgtaatcccagctactagggaggctgaggccaatcatttgaacctgggaggcagaggttgtggtgagccgagatcccaccattgcactccagcctgggcaacaagagcaaaactccttctaaaaaaaaaaaaaaagaacgattgttaccttacttctttgccccattgttgattgtggtggaaggaccaagtgtgctggtacagggcaaccaatccctgggaacagagggcagaatggcaagaaatggaactgacaagttgacttattttataacaagttttctttttccctctcttctcccttctaggcatatcgtgagcttcttccttattatcacccaacttggcttctgctgtgtgtacattgtgtttttggctgataatttaaaacaggtagaggcttctagagaaaacgggaggggaaaagatggacaaggacacgccactgctagttgtttgacaaactgcttcttctctctggtcctcatcaatgtaacaaaggaagttaaactagatgttgtcaaacttgcctcccctagttcacatatctgaagatctctgtgtggttacttttgccacaataccctttatccggtatcttagacctgttctcaaagttgatctctactgaactggaatggaaagacccttggattttgttaatcctcctgccttgaagcttaattatacttaacgcttctaaaattgatatgggtcttcttttgatgattcctagtcttctttaggtcatctttctttctttttttttttctttttgagacaggatattgctctgtcacccaggctggagcgcagtggtgagatcacagctcactgcagcctcaaactcccaggctcaagtgattctcccacctcagcctcccaagtagatgggaccacaagtgtgtgctaccatgtctggctaatttttttttattatttgtagagccgaggccttgcagtgttgtccaggctggcctcaaactccagggctcaagtgagcctcccactgtctcccaaagtactgggattatagcatgagccaccacatccagccttgggccatctacttaatctatggcttaatagttattgtccctaggaattctttctgatctaacctagaaattctcttacagcaatttgagcaaaataatatgggtaatagcagaggccatccttaatcagtaagtttaaaaagaaaactattctttagggctctttttctgcttatagcagtaataccagaaattcaaaaatgtaaactagctagaagaaaaatgtagtaagctttcagagttagcttctattatgtcaggtacagtgctgagcattttacatgctttccatcattgaattatctccatgaccttattagagcaggtactgtggttattcccattttgcagacgagaaaactgagattataaactctgtaatgtatgtaaggtcacagagccagagttaaaaacccaggccttctgacaccagtgctcaagttcttaaacctatgctgtatttctgcaaagaaaacaaaataaaataaaataattcttaatccaactattcatggttataatttaatgtaaccttaactggtcagtattttgcaatatccttatatttagtcatgtaatttttaatagtttcataatattccatcacacagattgatcataacctaatcaatcttctattgctggacatttcccttatttccctttgtttctctactatcatctgttggcacaaaagtctttgtgcacttctttatttccttaatgtttcttaaggtaaaattactgagtcaaagagtttgattgttttgaaggctcttaaaacattgccagattgctctttagaaagcaatctgacatgtacagacctatacttatcatctgcatttattgttacctgcatttatttatcatctgcatttattatcaaggcaaacactgtatcaaggagtttacagccaagtagagtgtgttctaaaacctaataagttaaatatcaatatgatattttggtgtcaggccaggatgccactaacaacaacaacgtgaggtcagggtgcaaactacattgcagagatcactggagcagggaaagcctcctccggggggtggtgcatctgagctgggtattgacaggttagagaaaaaaagtggtggcagccaaggtgggagaaggaatcagtgaaaaccgggaggcaggaacatatgggattgcccaggagaagcaatacaattggttcaaggaggaagagtaggtcatgggagaggaagaaaccttgaaggtttgatagggcccatttatggagggccttgagtacgtaactaatgttccagctatttttccaattgtagtgaggaatcagaaaaaaatcaatacttaaatgattcatttatgtatccacagtgtattgttaagtgcaagggacatttcaaaagaaaagagtgaatgctatgattgaagtcttgtaaaataaaaagaatgtgtataatatatgtaatttgtgatattgtatagaaaatatatagatgagtatcctccaagatgttagcatcttgatactgagattatcaatgcatttgtgttttcctcctgctgaactctagttcctaatcgttctgcagtgatttgtattgcttgtccagtaagactgtatcagttaggtcatgctgactttaaatggagggtggtagcatccacctacccctgactttacaagggggtgttcataatgtgtgggggggtgggggacggtttcttgtttatcacaatgattgggcatgctcatggctttcagtgggtggggtccagggctactaaatgttctgcaatgaatggtccaatccacacaagaaagagttttcttacttaaaatgccagtattgtgtcaattaggaatcagtaagcgtatatgttaattaggaaacagtaagtgatagactttttttattatacgcaaaaaaaaaaaaaaaaaaaaagattgagggaatttaagcagaaaataagttccatggaaggatattaccttccactaaattaaaaagcagatctgagggaagaacaggagccagggtagcgaggaggatatagatggaagaactagtgagcagcctccactatcggaattaatctttacccttttctagtccgtccttaggtccctatgctttaggtttacattcagattcctggaagagggtctgaatgccccagcttgagtcaaaggctaatcccctagctatgccacatgactgtgatttacagtcctcaaaggctgcattcaatgacaagaaagaactcaccaaaatcaaattggtatcaggagaaatggatactagttgctaaaagctaacaaatagccactgcgaatccagttatttattttgtgttacacttattttttaactatttttacaacttttttttttttttgtggatacagggccttactctgttgcccaggctggagtgtggtggcatgatcttggctcaagcgattcttgtgcctcagcctcctgagtagctggaattacaggcatgcaccaccacacctggctaatttttgtattttagtagagatggggtttcacgatgttggccaggctggtctcgaacttctgacctcaaatgatccacctgcctcggcctcccaaagtgctgggattacaggcgtgagccactgcaaccagcatgtacagcctcttctgaggtagtatggtgtagagggtttagaataagttctacattcaccctaactcaccgtgagatttggcactgtgggacactcccattcactgtgagggaatttgattaggggcaaggcactgagtcaaccatgaggttagaagactcatcatctcccccttttgcctctcccattccttcctcaggtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggtgagtgcacaccatgcacctgcccactccactgggcagggtttttttatcaaggatagactgagctttagatacctggagccaaccctgtaggtgggtaagagtgttatgagagacatgcatctcactgtagcatttcttctacaaggatgtctccgtgcagtcccattcttctgattgtctccttgttcatgttctttctccaaatatctatttttatgtcaaattctggcttttttaaaaaaatgtgcttgcaaggaaaacatcttggttggtgaactgtagaccattcctataatggttggctggcagcaaaaggcaggcgaaaacagattcttgtactacagctaaaagttattgcgttacccatagggtacaatttcaggtacccaataggaaggcaagaaaaaaaaaatctaatatttagtcacagagatatacatagagagtctcaaaaaccataagctttcaataagtgtcttgttactaatttaaaaaaaaactataagcaaatctattataatgttagttataatgtctttgatgttgaattatggacattgattttctgtcagtttcctaatttgctatcctttctaatttttcttttatttatttacttacttattaatttatttgagacagactctcgatctttcacccaggctggagtgcagcggtacaatctcagctcactgcagcctctgcctcccgggttcaagcgattctcctgcctcagcctcacgagtagctgggactacaggcaccagccaccacacccggctaatttttgtatttttagtagagacggagtttcacgatgttggccaggctggtctcgaactcctgacctcaagtgatccccccgccttggcccccccaaagtgctgagattacaggcatgagccaccacgcccagcctaattcttcttttataatagacaacactacatagaaagttaagtctcagaagccccttggcatatttaataaattccagatgttcttccctttaagaagccacaagagaaaaaaagttacattgtccgtgaaatttagtaaaaataatagtcaaacattttagaataactgcagatcagcctcacataccttagaagacactgatgaattctataaaattgaatttcctaaagaaatagctacctttaatacatttttggacaattccaaaggttgcccagttagaaaaatggctctgtcatcattttcacattctgggtcacaaggtatatagaatatttattctacacagtcttctccccttcaatttacagctcattaaagaaaaaaatggatctttcatatttaactcatactttgggctccttagattattactatgactgcagtcacaggaatttccaacacccatgaccactgtccattcaaaggtgttcgtgggctcgttgggtcagtgctaatctgtggtgtgtaaggtcttcttttggaggattgttttgttttgtttttgagatggagtttcgctctttcacccaggctggagtgcagtggtgcgatcttgggttcacaccattctcctgcctcagcctccagagtagctgggactacaggcgcccaccaccacgcccggctaatttttgtatttttagtagagacagggtttcaccatgttggccaggctggtctcgaactcctgacctcgtgatctgcctgccttggcctcccaaagtgctgggattacaggttaagccactgcacccggcccttttggaggtttttcataaaccaaactccctccatgaaatactattccttcagtactttgacaataccgtcctctggctctttggcattgtgcagtgttgaaatcaactttgatcgtggcctacatccctttgaagttttctaaacttcttgatattcaattttaaaaaattcaggtctcatttcagagtacccttctcttaaaggagctcaaatgtgctttaagagtgactgtctcatagcatttctttcttctttaggaaatcccagaccccagccggttgccactggtagcaagctggaagacctaccctctcttcttcggaacagccattttttcttttgaaagcattggtgtggtaaggtttgaattgaggtggccttatccctagtgcttgtgagtgaccttctagaaaggaactgtgagctctgggtttctgtgtcccgctggccattgttttgggcctgctagaaaatgcccatgggagaaagtaacctctggccttacttgggacagttgtcaccagcaagagaaaagttgattacaacagagaggcagtcaggagacagttttatttttgtccccacatgcctattaaacatctatcctcctatcgacatgagtttcctaatcttttaaaatcaagaagaaccatggtgtccaatttaaaggatttgattaaacataaaggagttttaacctggaaagttctgtatttacagtctgtagtctctacttccacacttgtggaagggtagtgttgtttatatatttttaaaagttacttttagtgtacatacagtaacattcacttttttggtgtacattcctgtaagtttcaagaagcatgtagaggaataaatgcaccaaagtcagaatgcagaacaattctccttctgttctctgcctgtactgtcttctcttttccaaaatgtcacatatatgggatcatacagtatgtatgagattgagactggcttcttttacttagcctaatgcattttaaattcgtccatgctgttgcacacatcaataacaccttgctttctattgcagagcgtccactgtctgggcagtaccacagcttatcaacgcacctgtcaaagaacatttgggttgtttctagtttttgacaatcatgaatgatactgccgtaagcatttgtgtacaggtttttgacattgaacatcttttcatttgcttgttggcaatttgcacatcttctttggagaaacatcaagtcctttgcttatttttaattaggctgtttgtctttttgttgagttttaagagttctttatatattccagatacaaaatccttatcagaaaaatggtttgcaaatattttttcttattcttgtcttctcctcttcttttttccttttaaattttttcctcttaaaaatgagatggagccgggcgcggtggttcacgtcggtaatctcagcactttgggaggccgaggcaggcagatcacttgaggtcaggagttctagaccagtctggctaacatagtgaaaccccgtctctactaaaaatgcaaaaattaactgggagtggcagcatgtacctgtaatcccagatactcagaaggctgaggcaggagaatcacttgaacccaggaagcggaagttgcagtgagctaagatggcgccactgcactccagcctgggtgacagagcaagactctgtcccataaaaaaaaagagagatgggatcttgctatgctgcccaaggtgggttttaatctctgggctcaagtgatccacctgcctcagcctcccaggtagtggggattatagttgcatgaccacagtccatcacacctggcttctcactttcttgatagtgaactgtgatgcacaaaagtttttgattttgataaattccaatttatcctctatctttctggttgtgctttttgtcttatgtctaagaatctattgcaaaatctagggtcatgtctagatatggtggctcacacctttaatccagaactttaagaggctgatgcagaaggatcacttgagggcaggagtttgagaccagcctgggcaacatacagagaccctgtctctgcaaaaaaaaattttttaattagctgggtgtagtggcacacacctgtagtcccagctactcaggaaaccaagcaggagaatcacttgagcccaggagttcaaggctgcagtgagctatgattgtaccacagcactccagcctgggtgacagagtaagaccctgtcttaaaacaaaacaaaacgaaacaaaaacagaaaaaaagaaagaaagaaagaaagaaagaaatcataggtcatagagatttacctcagagttttcttctaagagttttatggttttagctcttacatgtaggtcttttatccattttcagttaatttttgtatgtggtatgaggtaagggtcaaacttcatgttttcatatgtggttatccagttatcccagcacaatttgttgaaaaggctattctttccatattgtatagttttgacactcttgtcaaaaatcaactgaccattgatgtataggtttatttctgtactctcaattctattccattggtctataagatcataagtctaccattatgccagaaccacacagttttgattactatagttctatagtattccactttaattggcctattgactttttggctatatctttttctatagtacttttagtagtttatctaggtactataatatacgttttcacaatttactgtgagataatattttatcattgctagtaaactgtcaaaattttacaattacatagggcccttccgcctttatgttgtattgccttatgtatctaaacacactgaaacaccaacaatgttatcatctttgctttcaatagtcatgcatagtccttgtaataaacttactagggaaaaaataggctattatatctactcagatatttaccatttctgtcgctctttctttattcttgaaatcccatttccttctggcatcatttcccttcagcatgaagaaccttcattaacatttcttttaaagcaggtctactagtgacaaattatcttcattttcttgatctgagattgtctttattttgcctttattcctagaggatatttttgcacaatatggaattctaggtggacaatttttttcatcattttgaaaatatgacttcctttctttttgccctcagtggtttctgatgagaaatctgcaattgtttgaatccttgttctcctatgtgtttttctctggttgctttcataactttttaaaatcttctttaatcagcagttatactgtattatatttaatatagtttctttgagtttgccctctacgagatttcttgaatctgtaaaagtttgtcttttacctaatttacctaatttcagccattatttttttcaaaggttttttcttcaccaatctctttttcttctccatcggagatcccaataacctgaatgctagactttttgatatatagtcatcgcttagcatatataggacattggttccaggaccccgctcccccacccccctaaacacacacacccagtgtataaccaatctgtgcctactcaagtcctgcaggtggccctgcagaacctgagtatatgaaaagtcagccctccatacatacaggttttgcagcccatgaatactgcagttttgatgtgcatttggttgaaaatatccacctatttgagggcctgcgcggttcaaacccatgttgttcaagagtcaactgtatatcccacaggtttctgaggctctattcatttttttaaaaaaatctctttgctctttgttgttcagattttgtcattcctgtttatcctcaaatttactgagtttgttttctgttatctacattccgctatcaagcccctacagtcagttatttaaatttttcttattttccagttataatatttccatttgtttcttttacattgtgtctactttgctaagaacttgtatctgtccatttattttaatagcgttctcccttactttttggagtacggttatattacctgctttaaagtctttgcctaatattgccaacatttgagtcatcttaaggttggcatctgttgtcttttctcttgaaagttgatgagatttttctggttctttgtaggctgaataattttaaactgtatcctatgcattttgaatattattttaggagactcttcagaatgctgatttttggttttagcaaaccatctacctagttagattcagctcataagtccttgctcaccttctgtgggccatggttccaatatccagttagttttcaaagcccatgaagtgatatttggctctaccctgctcatgtgctacacagtgccaattggcagacaggactctacacagtagttcagttttcaaagcctttgctttgatgcttcccatcagttccacatatgtacagctcagggctgggcccaggatattattcacagattttaggagattgctttttccagtttcctcttctctgtgttttcccgcacactcgccagctcgcagtgggttctttttcccatcctctggctagaaatctaggcttttagcctcctacactgtcatgtacttcctgtgaccaagtctgcctctggggttgagcaatgagtgaaaagagaaagaaaaagcacaatagtgattctttcctggaccagtttcgtgagcaggcaaatcatgcagccacatagggtccaaccttcagaagaatctcacacttagtttaacactctgctggaaccatctttcaccaaggaaccctgcattttcattttgtactggggcccataaattaggtagccagtactgatttcccacactcttcagactcctaaagccaattttcctagtacttctgtgtagagataaggatttctatctcagatttttaggtgcctgtgtgaccactacagccactgatacaccagaatgctgcttagtgactaggacttgccttgaggtcatggcctggagataaaacaaagaaacagaaaaatagagattctctccacgctcttcatcccacaggggaccctattctaagtcatctgtccaaaaagaagtttctcttggtgttattttctgtctgtatgcaccgcatagttctaagatttgggtgtcccttgaggttaaaaactaggatgtatgggaagaagaaaatcaggaaactcaccaccatgacagtcattttttctttttgatttccttccccattctgcctgctactatttactcttcaggacctgtgcataattgctttatgtatttcatccacgatttttagttgtattagtgaaagagatattgtgaagtgtgcttacttcatctagatggaactggaagcactttgtttttagaatttggaatagtcatggacaaaagcagagtgcagcagttgagcaggtaactttggaggcagaatgtgctggaatcttgctttggccagggctactctctgaactctaattctccacctctaaactgatgacaatatttgttcagtaagtatttcttgaatgcctattatgtgcttgtgattcttagtattagttgaaattatcttaagaagaactctgctagcccagtctccaattttacagaagagggagagccccagagagagaaggtgacttcagttagatcaccagctaggaactgtgcagatgtgaataaaacctagtacgtctgactctccatccagggaccttcccactgtacgtcaacagccatttatctctttgactgactgattgtggagagagagagagagagaaagaaaggaagccagctacccagtctgagcaggccttgtgaaaagatcatttttggccttgagaatatatgcagcaaaattgtgttacagggtgcaagagctcaggttggattgtctgctctccatacaattattgtataatcatcaaacatcctcctgagcacctgctgcaacgagacctaatccagaagaaagtggaaaggcatggggaggacccaacatgacactgccctcaagcatcttccaaatgcctggaatagagagagggttagggagtttcagggctggaagtttgcatgtacgacagaaaagaattcaacagtacaagggaaaagatgctaaattccttagtaacaaatatacccattgctataggagtagaagcaggtacttggactttggataacagccctggtctacaacctgaatctgacactttctggttctgcaacttgggatcagttatctcattttcagagccttgttttcctcatctgtaaaacaagaattatggaggtaccgacttcatagagttacggtcttcacagtattaaaaaataacaaccgccaacatttactaagcccttaactgtgccattatggtgcttgtgtaattctctacaaaatttgcaaaattcagccacatgtgatgtctctcgcctgtaatcccagcactttgggaggccgatgtgggaggatcgcttgagcccaagagttcaagaccagtgtgagcaacatggcaaaactctgtttctacaaaaaaaatacaaaaatcagccgggcatggcagcacatgcctatagtcccagctcctcaggaggctgagatgggagggatctcttgagctcgggaggcagaggttgcagtgaactgtgattgtactactgcactccagcctgggtgacagagtgagactctccaaaaaagaaaaaaaaaaaaaggtaaattcatttgagcccgttttcagataagaaaacagatcagctaaatagtgcatgtagagaatgcttagcacacagcctgaacaaggagtaggagaaggtgggggtggtctccaggacaataagagcctgaggaggaaattatgggatgagagacaggaagattggtttcaaagacagaagagaccttcaaatgtccaaccggcaagaggcagactggcctcaacttggattctcttagaaccaggtatgcatttaggggaagaaggattctgagaacagaagagtgagaacctggggtgtggggaaatgcactgctggcagaaccaggaagcgctctctggtcccagctgccaccagcaccctgtgttcctggagtctcagcctccccactgtacagtgatggggttggcggagggagtctgcacaggaattaggagtttcaaacccaaatgcctttggaaggcaggtataattcactggtaggtgggggtgaggggaggtgggcctggtgaatgggaaaagaatgttgtgcctaaaggcattcatattcaattgtcgaaagactgtgctgtcaaaacaaaacgcatctgctggccagatctagctgccccagagtgttgagatctttggtctggataaaacctcagtggcccttccagctcttaagggtccagggctcatcagatgactccaggcctttctttttatctccttcctcctccttaccctcatcttcctaccttttttcctcctcttttatttcctttttttgtttaattgaagcacacctaacataaaatttactcatcttaaccactttcaagtatacatacatattaagtaaattcagattattgctttctttcatctgcagaactcttcagcttgcaaaactgaaactctgtacccattaaacaataactccccatactctcctcatgccagtccttcccaactagcattctgcctctttggacctacctactccaggtacctcatataagtagaatcaggcagtccttgtctttttgtgactggcttatttcactcagcaataatgtcctcaagatccatccgtgggttagcatgagacaaaacttccttcttttttaagggctaaataacgttccattgcatggatacacccacattttgtgtatccattttctgttgctagacccttgggttgcttccaccttttggctatgtgaatagcactactgtgaacataagtgtacaaatatctctttgaggccctgctttcagttctttggggtagacatccagaagtggaatgccatttttctttttgttcatgttactctttctccttcttacattgtgatgtttctgtaggttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggtatcttcatgggctgtcaggtggtggggactcaggaatgggtggaaacgtataggtcacttcctcctcccttccacagctgggaaactgaggtctagagagcctcccacagaagaagcagaattgtcattggaaccacggtctccagattctctgtcctgggagttcctccttcaacaacagcctcccaaattgagttaagccttgacatcttagtgtgaaggaggacatgacttaagaagagaggacacaagtgagagcccttggtctactaaggagagaagggaagggcactgggagatggcaagagacagagagaggagtcgggaggtggccacacttcccatagtcttgtttgccacagccagtggttcacattccccaagtcagagtaaccagatagaaaagtggaaaacaaaaaccaattgggccaacctgggcaacatggtaagaccccacttctacaaaaaaaatttccatagcttagctgagtatgatgtctcatacctgtagtcccagctgcttgggatgctgaggtaggaagatcacttgagcccaggagtttgaggttacagaaggctatcatcacaccactgcactccactccagcctgagtgacacagtgagaccctatctcttaaaaacaaacaaacaggccaggcgtgatggctcatgcctgtaatcccagcactttgggaggccagggtgggtggatcacctgaggtcaggagttcaagaccagcctggccaacatggcaaaacctcgtctctactaataatacaaaattagccgggcatggtggtgggtgcctgtaatcccagctactcgggaggctgaggcaggagaatcacttaaacctgggaggcagaggtttcagtgagccaagatggtgccattgaactccagcctgggcaacaagagtgaaactccatctcaaaataaataaataaataaataaataaataaataaataaataagccaggcatggtggcacacacctatagtctcagctactcaggaggctgaggcaggagaatcacttgaacctgggaggtggaggttgcagtgaaccaagatagcaccacagcactccagcctgggcggcagagactctgtctcaaacaaacaaacaaacaaacaaaacaatttgggaagaccattggaatctgtaaaagtcttatgttctagcatactcaattcatgcaatagttagcagccccatagacatcaacagtgccatattgaacagacgcatgaacccacatcccactgtgcgggattttctcccacaccaggtcatgtcattaattacaggacatttcggtcttctcaagcggacagtcacagtcccttggagacctaatttgcctaaatgtggctcctttcccaacatgataatgccactcatcaagcatttactgcatgccaattataagcagatgccaagtggcactgatgtgagtagactataaccttggaggttcactatcttcgccggctcctgatccggtgggaatgggggaggaacagatagtgtatgtacacaaacaataacatagaaaaagaagctctccagagtagcaaacaggccttggggatttccaaggaaagaaagcacatcggaaggagacaacagggaaactccttgtccggcaggtcaactcaatccaaacatggaccactctggtacacctgagtccaggtcccagttggactgcctactagcttgtggttgtagatgatttacttcaactctctgaacctcagttgcctcatttataaactggagttgtcatgaggattaagttgagctgtgtctacaaggatctggctgtggtacctgctcagaacaggggaatttcaaaaacttggaggggtttgaacagatggaaatggagtaaagagggtgcccaggcagcaggactagtgtgagcaagaaacacagaaatgtggaagttagcctttttaaggaatgggctaaacacacacacacccatttatttatttatttatttatttatttatttatctatctatctatttatttttgagacagggtctcactctgtcgcccaggctagagtgcagtggtgcgatctcagctcactgcaacctctacctcccgggttcaagtaattctcctgcctcagcctcccaagtagctgggattacaggtgtgcaccaccacacgtgggtaattttttatttttggtagtggtagggtttcgccatgttggccagactggtctcaaattcgtgacctcaggtgatccaccgccctcggcctcccaaagtgctgggattataggcgtgagccactgtgcccagcatcacacatttattaaacatggaaatgcatctactgcattagtggactgaaggaaaacagtcacatctcaatagatcaaatagaaaaaaaacttagatagaactcaatatcccttgaagcctcacacacactctgcccctagcttgaggctggcaagtacccctgtttctccttatattccaccctgactccccctaacttccacacaaccctatttataaactgtctcttcttccaaggatttgggattctgcagttctctcaactagaggcaacagttatgtgcctagagctttggggaatccagataattcctaaggactgatcacaaaggactagagtcttttagatccagggcttttggtcttagccacttatcatctgtgtctccctgggcaaagtatctggcctgagcctgagcctctcttttttaaaacataagattgagcatcagatggtagcgatttgcgaaggtgcaatacatactcaagctcaagatggtttttatttcatttagaaatgaccctttccattgtttccactgaatccagaaccgcactattttcactgcatgctctgctgtgactccctcttgattcttagaaggtccctctcagtcattttcagaaagggaaacaaaagcccaagtcattgtcccaaggtcagaggttaatgttccaaggaggccagtgtcagaacacagtggccgtggagagcagctctgtggtttgtcttgcaggctgtaccagtctgtcaagcttctctacattgccggcatcctgtgcacctatgccctgcagttctacgtccctgcagaaatcatcatcccctttgccatctcccgggtgtcaacacgctgggcactgcctctggatctgtccattcgcctcgtcatggtctgcctgacatgtgagtagaaaggagagtgcagtgttcctgctgatcttttctgagggctataaagaatcagccagatgggccggatgcattggcttacacctgtaatcctggcactttgggaggccgaggcgggtggatcacctgaggtcaggagtttcagacaagcctggccaaaatggtgaaaccctgtctctactaaaaatacaacaattaaccaggcgtggtggcacgtgcctgtaatcccagctactcaagaaccaaggcaagaggatcacttgaacatgtagggcagaggttgcagtgagccgagatcgtgccactgcactccagcctgggcaacagagcaagattcatctcaaaaaaaaaaaaaaaagaatcagtcagatggtagagggcagtcatgacaatcagcatttactgagcacttactgtattccagggaccattttaaagctttacaagtattcactcatctaaacaaccccattcttacatgtacctaattagacagatttgttggtgttcagcctaagggattgacacagcttatcaaacaataactgtaagaacttgctgcgcactctggcacatgcctgtgatcccagcactttgagaggtcaaggcaggcggattgcttgagttcaggagttttgagaccagcctggacaacatggtgaaaccccatctctattaaaaaaaaaaaaaaaaagaaagaaaagaaaatagccaggcatgggtgccccatgtttgtagtcccagctacttgggaggctagggtgggaagattgcttgagcccaggaggctgaggctgcagtgagctgagattgaaccattgcactccagcctgggcaacagagtcagaccctgtctcaaatatattaataaataaataaataaataaataaataaatcataagaactgacatgtattgaacacttactgtgtgccaggcactgtgttcagctctttctagtctagatttcataatattttattcagtcctcacaacaattatcatgaggtagaactatgataaaccctactttatgaaagagaaaactgaggcagtgagtgattaataattggccagaaagtgtcagaggtaggatttgaattcaagtcatgtaagtctagagccagtgcccttcacctccagggcagacattgaaaatgggactctaatttggcaacaggtgttgtttgaacctcacaatgttgtataaagtgggccaacatttaaaatgtgggcaatctccatacaaatgcagatttttaaaattttttggtggggctactataaaatgattgggcaaggctgggatcacattccccatcggcaacaatcagctggggctccttgacccctggacggtcctgtgcttgcctattggctgaggtcattcccactccctggctcacagcagcccccatgacccggagtacccctttctgcaagtattccaccagaggccgaaggagatggctagagattcctgtgtagagtagaggtggcccagctgtccctaagatgccttttgattgtaattgcaaaagtgtcttctttttaaggccaaattgtattccactgtacgtagaaaccacattttctttatccattcatctgtccatggaaatttaggaaattcttttttttttgcataacaaagtgttacttttagataattatcagtacaccgagtaataacatgtaacgagtttttgaattctaccatctagtaattttgattcagagaaactaaaagcagcccaaacagttatgctagtattcattattctaaccattagcaggaatggactaatttaagggtggctgctgcttcacacagattacaaataaccatttactactttttcatggttagaatcctgacattcaagaaagcactacagggaaaaaaaaaatattaatctctttcttcttcaaagaacttttttttactagaaaaaagaaagaaaaagtcaacattgatacactgatacatatgttacttcagctaataggcatgggaaaacatgacatatacccattaaatttctacgaaatacgatgtaaaaagaaaatctatagataagttctaagtctgtacaaagaagctagattttatattctctgagatgtgaagggacctgctatataatatacagaaatcatttaatgccttttcataagaatatatctcaagctgcatattcctcgagggcatctaaaatgccaatctgtggtacaggcgcttctttctcccactcttcttcatttatgcagcagttttcatggatttctgtccaggtgtcacagacaaaagccaagagactagccaagccttcacccccattctgctggaagtagttctggaggctggtcctcttcttctgaccctcctgtgccacttcagtgccaaggctgctgtgagattccagggctgcagcttccttggtcttgaactctttctccctctgcaggcagtgctgttcagtttcagttcagcagttgaagcctcagctgcttccttggcctgcttcagcctctatgtttttgctcacacttggacaccttctcagtggctgcatcttggcctgcagcagctgctggatcccctgagactggctgaagtggctgttgattttcacttttctaggccagcccacagcattcattcgacactgattttctttttttgaagtgattagttctcaatttgaccttgaatgcaggaactatccagtatcttacatattccagacagatcaaggaatttgccccacagtataaagataacaatcccttaagcctacactacacttcttcatgcattgtcaattagcatgtatgagtaaataacttggagtaatagcaaagataacttttctgaatgctttacatgaaaaatctcattgaagacttttatgtcctatgcagaatgaatcacaatacctaaaaggatagtagccttcatctccattttgcagctgaggaaacaagctgaggaaggggtgggacttgggcaaggccatacaagaatgaaccagactcctgccttccagacctgttctgttctaccacactcctccaaaggaggcctgctcaaggctcctgggatttattggtgaccaggaacatttttcatcaaatataataaaaaatgtaaaagcccaggtctgtaaaacgtcctgctaaaaaaatataatttcaaaatttttagcttttcgtgtttctttgttaggggttttctgacatgtgtataaaacctggagaagacacttctttaaagacacctcccggattttcttccaactgaagatctctttgtattataaataatttcatattctaattgtttgcaagtaaaaggttcttatactcatgttaattatttattaaaattctaggcattttaaaaaataatttatttatttatattatttatatttattatatttttatatatataaaatatttattatatataaaaatatattttataaataaatatttataaataattattatatttttatttattatttatttttattatagataaaatatataaaatatattttatttatatataaaataaataataaatttgtattatttatttatattatttatattattttttatttattaaaatgctaggcattttagaagacttctaaaaaatttgtacattgatacaaattttgatagtacaaacattgacagtttgtacattgatatattccaaacagcttgaatggttcccagcactgttatttagtgttatttattaagtaagagcttaagttttgttggatatgtaaggatccaaaatgcacctcggtagcataaagattattttaagctaaaaatgcctgaacaaaaagaagctgcagaaagaaactttgtctaatcttcttttgctgatgtaagcgggacctcctgacaaatatagctgccataaatcccttctctgggaagtttagagccagaaaagagacttagcattatcatgggaattactaactgtttaacaaattttatctgaaactgtcatatcttccatttgttcttccataaaagccctttctcctccctccttttccccttattaagggggtatctttggctgttctggaagccaattcttctcaaggctctggagcttatatatacactttgtcttttctcttgttaatcttacctattgtcagttgaattcacaagcacccaaccactgaccctaagttggtaggggaaaagtttttgaatgaatacatttcctcccaacaatatgaatgaacaatatgaatgaatacaattagacagagactcaccaaattttgttattgttgttttgagatggggtctcactatgttacccagggtgtccttgaactcctggatcctcctgcctcagcctcccgaatagctggggctacagaaatgtgccactatgcctggctgaatttttaatatgtaacttctagggaatatgattagggatattggaggacttttaacttttctttctgtaattgaatttctgagaaacaattagttcattttttaagaagaggattttttttttttttttaatgagataggacctcactttgtcacccaggctggagtgcagtggcgtgatcttggctcactgcaacctccacctcccaggttcaagtgattctcctgcctcagcctcctgagtagctgagattataggcacccactaccacacccggctgatttttgtatttttagtagagatgggatttcactatgttggacaggctggtcttgaactcccaaccttcagtgatccacccatctaggcctcccaaagtgctgggattacaagtgtgagccactgtgcctggccaagaagaggactttaagaacaaactttcaaagcttggctaagcctggaatgctccatctctccactatcctctccctgcaggcctcctggccatcctcatcccccgcctggacctggtcatctccctggtgggctccgtgagtggcaccgccctggccctcatcatcccaccgctcctggaggtcaccacgttctactcagagggcatgagccccctcaccatcttcaaggacgccctgatcagcatcctgggcttcgtgggctttgtggtggggacctaccaggccctggacgagctgctcaagtcagaagactctcaccccttttccaactccaccacttttgttcggtgagcctggcactgctccttgcctaccagcacccgacttttaattatatggatctctttttttttttttttttttttttgagacggagtttctgtcttgttgcccagactggagtacaatgatgcgatctcagctcaccacaacttcggcctcctgggttcaagcgattctcctgcctcagcctcccgagtagttgggattagaggcatagtccagcacgcctggctaattttgtatttttagtagagacggggtttctccatgttggtcaggctggtcttgaactcccgacctcaggtgatccacccaccccggcctcccaaaatgctgggatcacaggcgtgagccacctcgcctggccagatctcttttatatgcattatctttatgtcactgctttgccttttctctgggccaagtcatggtgaaacaagaaagctacaagctctaaatggtaattttttacatttttgttttgtttattacttcttcttttcatacctctggcattccactacattgtgagctttcccttggaaggctctggactctatccaagcttatgataattcacacaatgaatttcatacctagcgtggagctatgcaagaagcagccaccagagggccccaagtggcagcaactggccaaaggagatgcagccagctaagactgtccacactttggcagacaaccggttttcccttttctgggtctgttcaaaaagcaaacattaagggtgggcacataatccacaagccagaaagttgtgcacggctccagtgttgagatgggtagggccaagatgaccagtgtgaaaactctcagatagaaaggagccatgcatattaaatgaggggcaacaaacatttcaaacgattagataacattttctcccaactcaaagatcccaacaatgaataggaggcatggaagtagatgtgccaatggggagggatgaggagtgaacatgaatattatttgaatagactttacctcttaattcttgcaacatgcattcttgattacctactgtgtgccaaacaagattttgtagaatattgcaaaaatgaccataaattcctcgtgataatgtgactttgcacctgctcctatgaaaagatgaagtctgtatctgtatcccttaaatttttttgcttgtttgtcggttttgttttgtgttttgtttttttgagatgaagtctcgctctgttgcccaggctggagtgcaatggcacaatctcggctcactgcaacctccacctcctgggttcaagcgattcttctgcctcagcctcccaagtagctaggattacaagtgcctgccactatgcctggctaatttttgtttttcgtagagatggggttttaccatgttggccaggctggtctcaaactcctgacctcaggtgatccacttgcctcggcctcccaaagtgctgagattacaagtgtgagccaccacgcccagcctctcccctttaaatttgatcttggccttgtaacttgctttggccaatgggacattagtaaatgtgatgcagtcagaggtttggtaataacctatgcatcaggacttacatcacttgctgctctatggagttgagaccaccaagtaaagcatcctgggctagcctaccggaggatcagagaccatgtggaacataaatgaatcatcccagttgagccctgtccgcagatcaaccagcctaccaacttccagacacgagtaaagccatcctagactatatccaaccccagtcaggctgacacagaccataagaattgtacagataatccacagaactgtgataaataataaagatgtttgtaattttaatacataaagagtgggaagttttatgcagcaaaagataactgataaatcattctaaagaggatacactgattaatgagaaaagaatccctgctctcaagcagccagtctgctgtccattggggaagagttaacaggtaatcaactaagtaaataccatctaatgtccatctaagggcaaaggacactacctgctctagagcaccaaagaagactttccacaggtggtatcatttgagctgggctttgagtagaacctgaatcttctacgactgagcctgaaccttcttccattctgtcctgctgcctggacattacagcacctatgcttgtgtctgatcttggctggcagccagaggcaagccaacctgagacatcacctccatccttctggtggtgactgctctctcccctcccctcagaattactaaaattgagaaaacgcacctagataaataaatagatgttgaagatctatagtcccaaaaggtggggagaggagagtttctcatcaaactctccgtggtttacgggaatgagctatgcctgtttcagcctcggtgttaagagaacatttgaaaaagccctgtcctgcttattttcatccttcgtcttccctgtgccccccaattcccacgtcccggtctgctctttctgtatgttactttctatctgctggacttccagaagatacttcaccagcacaagtccactcagatggaggaaaggctggtggtccacacccagatcccatagcctacagagtccctgttgggcaacaggacactcatagctcgtgcaggggtccacagtccactttgccagagaatgggttgtcatttccaccctgagctctctgtttcatcagcaaacccaaaggacttccaatgatccatcctgagtgttggcaatgtgatcatcctctctggaaacatttctctcccaccctgctccactatcaatcaccgcacccatccttgaagtttaaagttatcttctctgttattaagaaaagtttacactcattctctaaagataagcccctactgtgtaagaggatagggttaattttattactcagacaaatctggctgaagttaaaccttggaaagaaaaactaaatttagcaacattgatataaccaacaaaactaagctagggagactcattagtaatcattggcaacactaaagactactacatgttagctttatgtctgagtggtggtgatattaaaatttcttaagtggtttggaactgatttttttagtacacacatatgcatacacacgactttcttccccccatttaacttactatttatttaacttctggaacttgctagtgagtcaaggaacatagaaaacccttcctcctttccttcattgagtgcttactaaggattttacatgagatcatctcatttaatccttacaatgacctgtgatgtttacactgtcattgtctccattttcagataaggaaacagactcagagacattaaataacttgttaaagatcaaacacgtagtgaaggatggatccaggatgcaaacatttgtgcatcaaagctcctcactgcattgtagggcccaagggaggccactgaatggtggttatcaaaatgtaaaatagggaggaggtagagcaagatggtagaaagctccactgatctgtcctgtcccccaacccctgctgcaaggacaccaatttaacaattatgtacaccttcataagaaccaaaaaacgtgggcactcacagtacctggttttaacttcgtatggctgaaagaggcactaaagaggtaaaagaaaaaacagtcttgaatcaactgcgcagcgccacccctcccccacccccagcaggggcccatggtgcccagagtatctctgggctctggggaagggagaacccagtaattgtgatgcattgactaggtgctgcccttgttatagcagaaaggaaaaccagaccaaactcagctgacacccgcccacagagggagcatttaaaccagccctagccagaggggaatcactgatcccagagatcagaactctagttcccacaggcctcaccaccatgggctaaagtgctctggggctttaaataaacttgaaaggcagtctaggccacaaggactacaactcctaggagactcctagtactgaattggacccagagacagtggactgggggagcaggagacatactgagacaccagttggggtgactaagggagtgcttggcatcacccctttcctaaccccaagaagcacagcttgtggctccagaatagaccccttccttttgcttgaggtgaggagaaggaatagtggggaggactttatcttacatcttagataccaactcagccacagaagaatagggcatgggtcagagtcatgatgctgcctttccagaccttagcttctgggcatttctagacataccctgggccagaagggaacccactgtcttgaaggaaaggacccagtcctggcagcattcatcacctgctcactgaagagcccttgggccctgaataaacaccagtgatacccagatactacatcaagggccttgggtgagactctgagacctgctgactttagttaccagctcagccacaggggtagagcaccaagtaggctcttggggtccccaattccaggacttggctcttggatggcatttctggacctgtcctgggccagagggtagcccactgccttgaagggtgagtcccaggccaggcagcatgcaccaaaagctgactgaagagccctcaggacttaagggaacattggcagtagtctagcattactccctgtgggcctgaggtggcagtggccatagggtgaggctgccctacctttggaaaggggagggaagagtgaaaaggactgtgtcttgtggttcgagtgccagctcagccacagtacaatacggcaccaggtagacttcttaggtttttgattctagtccctggctgtcaagacagatggcacctctggacctgcatacagcctgggggaactctccacattaaagggaaaaatacagacccgaatggcttgccacttactgattatagagccccagagccttgagcaaacacacgcagtagccaaggagtggttacaggaggcctctagcaagacccagtgctatgctggcttcaggtctgacccagtgcagtcatagtgatggtggtcacaagggtgcttgtatcactccacccccagcttcatgtggctcagaacaaagagagagactctgtttgggagaaagtaagggaagagaacaagagtctctatctggtaatccagagaattctcccagatcttgtccaagatgattaaggtggtacctctgtcagtctgcaacaaccacagtgttgctgggcttgggttgtgccctgaagcagatacaacttagatcacaacacccaagccctttcaaatatctggaaaacctccccaagaatgatggatacaaacaagtccagacagtgaagactgcaaaaaatacttaactcttcaatgcccagaaactgaagagcatttactagcatcaacaccatccgtgaaaacacgacctcaccaaatgaactaaataaggcaccagggaccaatcctggagatacagagatatgtgaactttcagtcagaggattgaaaatagttgttttgaggaaattcatagaaattcaagataacatagagaaggaattcatcagataaatttaacagatattgaaatcatgaaaaagaatcagaaattctggagctgaaaaattcaattgccatactgaagaatgcatcagagtcttttaacaatagaatcaatcaaccagaagaattagttagcttaaagataggctgtttgaaaatagtcagagaccaccaaaaaaaaaagggataaaaaataatgaagcacacctacaggatctagaaaatagcctcaaaaaggtaaatctaagttattggccttaaaagaggaagtagagaaagagataggggtagaaatgtcattcaaaaggataatagagaacttcctaaacctagagaaagttatcaatatccaagtacaagaagtttatagaacaccacgcagatttaacctaaacaagactaccttaaggcatttaataatcaaactctcaaagatcaagtataaaggatcctaaaagcagcaagagagaaaaacaaacaaaaacaccatggagctccaatatgtctggcagcaagacttttcagtggaaaccttataggcaaggagagagtggcatgacatatttaaagtgctgaaggaaaacacttttaccctacaatagtatatctggtgaaaatatacttcaaacatgaacgagaaataaagactttcccagacaaacaaaaattgaaggattttatcaacaccagacctgtcctactgtgtccggaattggtgggttcttggtctcactgactttaagaatgaagccgcggaccctcgcggtgagtgttgcagttcttgaaggcggcgtgtctggagtttgttccttctgatgttcagatgtgttcggagtttctttcttctggtgggttcgtggtcttgccggctcaggagtgaagctgcagaccttcccggtgagtgttacagctcttaaggcagcgcgtctggagttgttccttcctcccggtgggcccgtggtctcgctggctcaggagtgaagctgcagaccttcgctgtgagtgttaacagctcttaaggcagcgcgtctggagttgttcgttcctcccggtgggctcgcggtctcgctggcttcaggaatgaagctgcagaccttcgcagagagtgttacagctcataaaggcagtgtggacccaaaaagtgagcagtagcaagagttagtgcaaagagcgaaagaacaaggctaccacagcgcaaaagcggaccggagcggattgctgctgctgtctctggcagcctgcttttattatcttatctggccccaccca

SEQ ID NO: 10 - DNA, 36400 bp, Homo sapiens
aaaaattaaaaagcagggtgatgaagttaaggcatagagtttttgtcagttttctttctttgtttttgttcatttgtttgtttatgcagtgttcatctgttatcaggttaaaataatgggttataagatagtatttgcaagcctcatggtaacctcaaaccaaaaaacatacaatggacacacacacacacacacaaaagcaagaaactaaagcatatcaaaagataaaaatcactttcactaaaggaagacaagaaaaaaaaagaaggaagagaaaaccacaaccagaaaacaagtaacaaaatggcaagagtaaatccttacttatcaataataacattgaatgtaaacggactaaactctccaatcaaaagacataaactggctgaatgaataaaaaacaagacccactgatccgttgcctataagaaaatgacttcacctataaaagcatacataggctgaaaataaagggatgaaaaaatatattccatgccaatggaaatcaaaaaaaagcaggagtagctatacttatatcagacaaaatagattttaacacaaaaactataagaagagacaaaggaggtcactatataatgatcaaaaagtcagttcagcaagaggatataacagttgcaattatatgtgcagcaaacactggagcacccagatataaagccaatattattagagctaaagagagaaatagataccaatagttagagacttcaacacccaactttctgcattggacagatcttccagacagaaaattaacaaagaaacataggacttaatctgtgctatagaccaagtagatctaacagatatttatggaatatgtcatccagtggctttagaatacacatccttttcctcagcacatggatcattttcaaggatagaccatatgttaggtcacaaaacaagtcttaaaacattacaaaaaactgaaataataccaagcagcctctctgaccacaatggaataaaacttgaaatcaacaacaagaggaagtttggaaactatacaaacacatggaacttgaacagtatgctccttaatgaccagtgggtcagtgaagaaattaagaagaaaatttaaaaatccttgagacaaatgatatggtaacacaacataccacaatctatgggatacagcaaaagcagtactaaaagggaagtttatagctataagtgcctacatcaaaataggggaaacttcaaataaacaatctaatgatgcatccagctgggaacggtggctcacgtctgtaatcccagcactttgggaggccaaggtgggtggatcacttgaggtcaggagttcaaaaccagcctggccaacatggtgaaaccccatctctagtaaaaatacaaaaaaattagctgggtatggtggtgggtgcctgtaatcccagttactcgggaagctgaggcacgagatcacttgaacccaggaggtggaggttgcagtgagccaagattgtgccactgcactccagccagggcaacagagcaagactccatttcaaaaaacaaacaaacaaaatgcagcttaaagaactagaaaagcaagagtaaaccaaacccaaaattagtagaaaaaaagaaataataaagatcagagcagaaataaatgaaattgaaatgaaaaaacaatataaaagattgataaaacaaaatgttggtttttttgaaaagttaaacgaaattgacaaaccaatagtcagactaagaaaatagagagaagatccaagtaaataaaatcagaaatgaaaaaagaggcattacaactgatactgcagaaatacaaaggatcattaatggctgctatgagcaactatatgccaataaattggaaaatctacaagaaatggacaaattcctagacacatacaatctaccaagattgaaccaggaagaaatccaaaacctgaagagaccaataacaagtaatgagatcaaagcaataataaaaagtctccaggtaaaggaaagccttggaccctatggcttaactgctgaattctactaaacatttaaagaagaactaataccaatcctactcaaactattccaaaaaacagaagaggagggactacttccaaactcattgactattatagaagttcagtattaccccgataccaaaaccaaacaaagatacatttaaaaaaaaaagaaaagaaaagaaaaggaaattacaagccaacatccttttgtgtgcttgctctgggtgatggtgatttccacggtctctgttttgtagttgcgagtttggctttgccttgttttaaaacaagcataacgtttattataattgatcactgtcttgtttacttgtttactgtttgtcttcctactaagggaaagacacactccttgaaaatggaaccatggtccatcctatttattgttaaatctgcagcaccttatatagaataggcatgggttaggtaagtattaaaacaacgaataaatgacatggcaaaaccccatctgttttggtttttttttaaatttttttctcgagacggagtcttgctctgtcatccacgccggagtgcaatggcgtgacctcggctcactgcaacctccgcctcctgggttcaagcgattctcctgcctcagcctcctgatttgctgggattacaggcacatgccaccatgcctggctaattttttgtatttttagtagagatggggtttcaccatgttggccaggctggtctctaactcctgacctcaggtgatctgcccaccttggcctcccaaagtgctgggattacaggcatgagccactgcacccggccacaaaaccccatatctacaagaaatacaaaaattagctgggcatgatggtgaatgcctgtagtcccaactactcaggaggctgaggttggaggattgcttgaggctgggaggaggaggtcacagtgaactgtgattatgccactgcacttcagcctgggtgacagtgagaccctgtctcaaaaaataaaaataaaataaaataataaatgcataagtgcaacaggggaggggaaattattttcaacttgagaaaaagtcttttgggcatcagaagagagagatatttcatctgatattcagaggaagagagaagctcccagtgctgattttacagcagcacaaagaggtggtgtggggagtaccttggcccccatgagcttcataagcaatctgtgcagtcatcccaaacaaacgtgcaatcaaagtccagtgctggtgcttgctctgcaaaagcagcttcaggacgcgattttgttaatgccagtcccattctttctgttactcatatcaaaaatattggagtcttccttgattcctctctcttttataccccacctcaagttcatcagcagatcctcttggctttatctttaaaagtatccagaattcagtcacttttcaccatctctttcactaccaccctggtttaagccactacagaccgacacctgggtcactgcaacaccctcctggattattgtaatagcctcctaattgatatcccttgcaccccttcaatctgctcgcaaaaaaaaaaaaaaaaatggccagagacatcctgtcaaaatgtttaagtcatgtcatttctctgctcagaaccctccatgatttctcatctctcttaaagtaaaatccaaagttgttacaatagcctacaagatcctgcccacccactccatcccgctttcattacctctttaaccacatctctggtgtgaccatgtaattatcatccaaaccaggatatctctttttattttattttattttttttttgagatggaattttgttcttgtcacccaggctggagtgcaatggtgcgatctccgctcactgcaacctccacctcccaggttcaagtgattctcctgcctcagcctcccaagtagctggaactataggtacatgctaccaagctcggctaatgtttatatttttagtagagatggggttttaccatgttggccacgctggtctctaactcctgacctcaggtgatctgcccacctcggcctcccaaattgctgggattttaggtgtgagccactgagcgtggcctattttatttcatttttagggtggtttcccaggctggcctcaatcgatcttcccatttcagcctcccgagtagttgggtctacaagtgtgcaccacctcgctcagctgcaggatacttttaataatgaagggaggcaccattagtaattatgccagggcaataggcacaaaccaggcgaatccattctcctctgtgtgctcccagatagccatatgacctcattgccattcctaaaacaccccaggcactctcctgcctcaggacctttgcacttcttgcccctctgctaggagtttcttacccaagacctacatgagttgtgttccctcatcttgttcagccctttgcccaaatgtcactttctaggtgaggccctctctgatcacccaatctaaaattgcgaccctccccctagctgaaactctccattacccttgcctggattttctctataccgctttttactaacagatacttgatatatttgtttcgtttattgtctgtctcccccagcccctccagattgtaaattccatgagaacagagattgtagtaagttttctaccctaatatattcccagcatggagaacagtttctagcatatattagatgctcaataaatattttctgaacaaatgattttttttaaacatgacctgcactcccttccaaatcactggcaggccatacgcctcctgtatagaaattctgagcaggtggcatttgaactgggccttacaagccactcttcaccccaaacagggaacatggtagctggattatgttctgttgggccacatctgcatcccaggattctgctgcagctcattggctgggcagcctccattgtgaggtagctctggttttttccttgccaaagacagacaagcactgagcctggccccacgtccaggcaccaggacctccaatccaatggtgtcttcttcctcccagtcacactgttcactttgccctacagcagcaagggctaaactaggagaggccaaaagcccaggcaagtcctggttgggcaagcaattgcgagtgaaactgaggaccatcctgactgagatgggtctttcataagtcccccaagagccaggtgaggcatcatcaacatcagcctctcctgccaccaccgcttccctgattcatgcacttcaggcttcagccagcagcacgcatccttggggttaggagccagcatctcaggtcagcagccatggtttctctggagaaagacccatcagaggctcattcagagccttaaccctgagcctctgccacctacccaccgtgttgaagatgtcattgcttggaagggactacaacagtgagctgaactccttggacaacggacctcagtcaccctcagagagcagcagtagcattacttcagagaatgtccatcctgctggagaagctggactatcgtaagtggccgcaccgcccttccaggcctgaggtcaagcactgctgtttttgcaactctggactatgtcttccttcatctatctccttaacacgcttattccattaacacgatatgcgtggataaaagatgaaaccttcagaatctaaggaggtcaatccctgtggctctggctactagccctgtttcccagtttttacgaagaacccagctagagcagccaccctcaacatgagcagcttgtctccaggaacagtttcctatctcaggctgtctgccctttccttcctccctttctttcttccacagtctctggctgccttcttctcctcacacatctgccattattctctctgcctcttctccccaaccccccatgccatccatccagaaaacaaaaggtgctaaccccatgtctccacctttactgccccaaactcagacacatggaactcttctctctttttttttaattaaattaaatttaatttaattttaagttccaggatacatgtacaggacatgcgggtttgttacataggtaaacgtgtgtcatagtggttttgctgtacctatcaacccatcacctaggtattaagccccatataccttagctatttatcctgatgctctcccatcccctgccccccacccccaaccagccccagtgtttgtcttgttctcctccctgtgtccatgtgttctcattgttcagctcccacttacaagtgagaacatgcagtgtttggttttctgttcctttgttagtttgcggagtatactggcttccggctccatccatgtccctgcaaaggacatgatttcaacagaactcttcttctaggacttactgtcaatcacactgctatctggtaatcatcagatcggtaacaactgtgggcacaaagagattatcgatgacaatccccagtgttgataaggatatcaggaaatgccctctctcatcttttgggaagaattaaattggtatctttctagatggcaatgttacaggtcaaatcgtaaaatgtcatttgtataaaacatacaaatatttatttggcaaatgctgtctgaaagtatacaactcgtgcacacacacaaaactgacagcagtggttgcctctggggaagagaatttggaggctgagagaaaagagatttatatttgtttcataaggatttggattattgcgttttatcttttgaattttgtactgtaagtattacaatctagttctttaaagtataatgaaatataaataaatataccctttgattaataatacccctctaggaattttttctgatgaaataatagcacaagagtgcataatttttatcaaagcacttgttataatgtaaccactcaatgggttcaccttgcccactgcctagacagagacgatttatcaagacaggggaattgcaatggagaaagagtaattcatgcagaatctgctgtgcaagagactggaggttttttttttttttttttagacggagtcttgctctatcgcccaggctggagtgcagtggcgcgatctcagctcactgcaagctcgagaccggagttttattatcactcaaatcggtctccctgagcattcgggaattagagtttttaaagataatttggtgggtaggagcttgggaagtggggagtgctgattgatcaggttggagatggaatcacaggggctcgaagtgagtttttcttgctgttttctgttcttgggagggatggcagaactggttgagccagatgaccggtctgggtggtttcagatggtccatcagagtgcagggtctgcaaaataactcaagcactgatcttaggttttacaatgtgatgttatccccaggaacaatgtggggaggtttagactcctggagccagaggctgcatgacccctaaactgtaatttccaatcttatagctaatttgttagtcctgcaaaggcagaatggtccccaggcaaaaagggggtctttttgggaaaggggtgataccaatagtcaaaccatgaaatgaattccttcccaaagttagctcagcctatgtccaggaataaacaaggacatcttaaaggttagaagcaagatggagttggttaggtctgatttctttcgctgtcttaatttcctcagttataattttgcaaaggcagtttcaataatattgaaaacttggaaacattaagagaaaggttaacacatgaaacaaacatacagtagaatatgatacagtcattacaagtgatggaggaaatgtatggacatggaaagtgtgtagcacatttattcatacagaaaattagttgaggatccagcatgcatagcggttctctttatgtaaaattcggtgcatttagagcaaataaagatgcccagaggagggctaattataatgtgtggttattttccattggtgggattttggaatttccttttataatagcaattgtatagttttcgagaaaaaatataaacccaattttttaaatctcaggggagcttgcaacatctatttatgcttcaaggtccagatgggtaaatgctgtcagctaaggcacagtggttcctccgaaaacttgtctcacctttcccacaatatctgattcaaataggggcaagacatcgatgctgtcatgggaaagaagtgagagacaaaggaaaaaagagcagagggtgggaaatgggaccacatcttttggagaaattactacttaagaattgacaaattacagttatcaagaaataaaggttatctcttggaagtaaagggacaatgggtgcccacccccccatccttaggtgaatagactgccctaacagaagttaggtcaatagacttcactcaatagactgaagtcacagaagtccccaacagttcatctgttctctcaacccaaccctctctcaggtcagcattgaaatgcaaagacctggttggttacagcttcttcctagccccttgccatgactctctaatggataagacaaagagatgtgagcactgtctctgctggactcacttgggcagttggttttggctctcctggccacctgcagacaatttaagtgtggcaagagggcattctctgtcttagcctgagacttcgtctgtatctcccaatggcatcttcaaggtacccttttgttcttgggtggagggggcacttctacttgcttaaaccagcccatgcttgcctttttcctatcatcccaattcttcttcctcttgaaggatgcgctttctaacaaatgagcaccatgaaggccaaaccaaaggtggcagtgaggatgatgatgatgatgagacaatgatatgacgatgatgatgctcacatctgtgaagcacttcatgattccatgattcatcatgttgttacctcttttgagtcttacagcttccctgggacataggcaaaactagaattttctcccttttttggcagtgaaacaggatcaaagcagctaatggcttcccaaagtagtaaccaaacacagtaggttagcggcagagctggaactcagaattaagtgctcccatctctgggttcaatgcttacgcatgtactttttatttaagttcctttttgattctgttctcatgatcctgttcccacctttcccacccaatccacatcaggattggagctgcctgggcaggagctgccagcacaggtgtgaagaatatttagaaccctaggccctagcaccctgctgggaccatcataagtactctatatgcacagtaacaattgctattaaattattaaattttacccagtgcataatgtcgatatatagcaattcatatatatataatatatatatatatatatatatcaccatgctcatctgactctactttgccacaattctccccacagtcctccccactccctagcatcacatgcagctcatttcatatatatatatatatatatatatatagagagagagagagagagagagagagagagagagagagagcgcacaagcaattcatattcacaatgaatattggttgaacaaatggatgaaggagtaaactaaaaccagtaaatatcccatatatggtagatttttgtttctagtgagtgagttaataaataacctgatgtctcactgtagactgaggcaactattactaatttttccattgtctatctaactgatagacatgtattaggtcacaataaatgttatttgagagaataactcatgaaagaaatcactggatgaattaatgaaccaaccagtactagagtgttatccagaatggtagcaatttttatttcctttagagcctagtgtgtattaaagatttgttgagtcacttgaactagcaccatccccagatcagatgttccaggacagacccctagaactgagagttgtctccaagtccacctcatcaggttttgcccctcttcctatcaggcgctctggagatgccagaaggaggctgagtttctggccatgcttcccttccactaacagtaccctctgtctccctactctccccaccacaggatgatgcaaactttgatccacttgttgaaatgcaacattggcacagggctcctggggcttcccctggccataaagaatgccggcttgttggtaagaggcatctgtgggatgggaactaggtttgctcatttgcagaagggggtgataggtcctgaaggccttcacactgttatcaatgggcaatttgggggtaccctctgcaattgaaaatgtgcctgttggcatcaatcccctggagtcaacctgggtccaacctgagcatccctgaagggggcacaccattactcttaaagactcaccatgctcatctgactctactttgccacaattctccccgcagtcctccccactcctaggatcacatgcagctcatttcgtcatttgcattaacagcccaatccctgcaggcatttgagtgtgtgactcctgttccaaaccacttgagggcgcatgagaaagtgtcttggacatgaagatagacgcctccatcaatcccaccaatccactctccccacaccagcctacctctttctcttttcctgtgctgttcctgccccctcatttctgtctttttaaagtgcctcctctctaaaactttacactttcttatgatcactaatgccatcctcactttgtatttttctaccatttatatctaccttacctgggattcttaaagcacttacgaagataagatatttatttatttattattatttattgagacagagtctcgctctgtcgcccaggctggagtgcagtggcacaatcttggctcactgcaacctccgcctcccgggttcaagcgattctcctgcctcagcctcccgagttgctgggattacaggtgtgagccaccacgcccagctaatttttgtattctttgtagagaggttttcatcatgttggccaggcaggtctcaaactcctgacctcaggtgactggcccatctcggcctcgcaaggtgctgggatgacaggtgtgagccacctcgtccggtcgacatatttattttctaacagacccaccttcctcatttaattgaaagctctgtgggcaagaactgtctgatttccctttgcacgtccccacggtagcctctgtagggactggcacacagcaagtttccattaacatctactgaatggaatagataccaaatatataattccatttccttggagtgaatcttttcttatctccaggcctggtaagtggcttctatgtctaaagaaggcgagacccttgctgcctctgtcatgacttctgatcttcagtggttccaacccagagactggactctcccctttggaatcctctgggttctagagcttctacaaaaaaacatggtcttcagccaaactatctttgccagggtggtatttgtttttaagacaatgcttttattctttgatatttgcttcctcagagtcattagatgatttctttacctttcatctcccaccagaacctctggccatgattcatttgagaaatatttattgagcacctatctaccctgtgcatttgtagcccctgggaatatagaagcaaacaagacacgagagtctctgctgcatgaagcctgcattccagtggagtctagtggtgctcttgatccctcatttatgtctttgtgataggtcacatctataaagacacaagtgttcagaacaaaggatgtgagagggtccccgtttatacccttctgatcacctctggaagatataattagtaatcagccccactttttaaaaggaatttgacaaattagacacactacagtagtgatccccaacttgggatcattttgcaccagctcctgctaccctagccaaagacctttacaatctctacagacatttttggttgccacaatctgggggaagagtctctgacacctagtgggtagaggctcgggaaagctgctaaacatcctataatgcaaaagacagctcctgataacaaataattatctgccccaaaatgtcaatagggcacctgttgataaactctgtactagaggaagagaactgagtcataagaacaccttggccctcaatcatcttggaggaagtgagggccagggtgtgtcagacaaaataaatttaccacaagggactctaaactggtagaactcaaggaaaatgagaaaatgcatgggctatgtgggaaggtaatgagctctctgtcactggaagtatcctagcagaagttgggcagccactctacagggatgctaagaagagcattcaaattctagcatctgggagcatgaggacattcaggctgggtctgtcaccccaaagacagttttattatgcaacaggccccagcacgcagactgtgagagggccagggaatgggagtgatcatttctggctcacttccccctttctcctctcccctccaggtcggtcctgtcagccttctggccatcggggtcctcaccgtgcactgcatggtcatcctgttgaactgtgctcaacacctcagccagaggtcagaggcctgcttctctctcattccagcactggggcccctctgagggtgtgttgctcttcttttgaccactgacccaattaattcggccactgctccaggccaccttcctaccaatctggattctatgaaggcaaggagagcatgacagagagtcccagttagagactctaggcacagatccaacgctgctgctaacaagctggatgactgtcaaattcctgcatccccctgagcccagatctccttaactgaaagcatcgaaagtgataaaagatgcaaaagcactatataaattactctatttatttgagacagagactttcttctcttccttttagcctctccatccccaaccttctcccactccaatacccacaccttgtcagggtaatttggtccatgcaatgttagtaaaagtaaaaagcatacttactgaaaagaagtcttcacaatgatttcagtcattatcaaagcatacttataataatcaatgtttatgtatttgaaactttaatgcaaaaacaatttcagaaagaaaagacaaatgcagtaaaaacaaagaatgcagagatccacagcgctcagctactcccaaggcatgcaaaaccaaataggtcctcgtaaatgtgaagaaaggtctcaaaagtcaaagtagggacggtaaacaaaactctccataaagcctaattatcataacccaaataggtgtacctggagtacatatcagtcacacctaactctcagagcactttcctgctcacaaaacgcttttaagagcatttactcattccgtagttaaatgtattgtgcaattacactgcggttatcgtgccaagagccttgcaagccttgtttactcctcacagtaagtctatgataggcactatttttattcccattttacagatgagtaaactgaggtttaaatgccttgcccagggtcatatagctgggaagtggcagagccagtattcaaagacctactgtgactccactgttaaccattttgcaaatcttctcttccctcaagccttctgggatcattatatcaccagataagcttctgacatcaggccatttctgaaagcctttctctgattttttttttttctctgatgacttgtcttttattttttctaatatagaggttgcagagtgatggcctgagagttggctatggccttcagttatgttttgggggacttcacagttttattttttagtcaatgtttaaaccctggagatttcggccgggtgcagtggctcacacctataatcccagcaattcaggaggccgaggcaggcagaccacctgaggtcaggagttcgagaccagcctgaccaacatacagaaaccccatctctactaaaaatacaaaattagccaggcgtggtggtgcatgcctgtaatcccagctactcgggaggctgaggcaggagaatcgcttgaacccgggaggcggaggttttggtgagccgagatcgcacccttgcactccagcctgggcaactagagtgaaaactctgtctcaaaaaaaaaaaaaattcacattcacaaaatgtgaattggagatttcacattcacattcacaaaacaaaaaaatctctgccttcttaatcagttagacaaccgactgcttctgagccttcattttttagatgtgcttctagaggcaactcctgagcaatcccttttacaatgggatgtgttattctggtttgccacagtctccaatgttccctactgtctcttatactcagcccctgtcacccaccagatcaccagtacctgtctgatcccatagcttctgaatttgcaaccctcagattcatatccttgccagttctatgcaaggtgacttcatttgtattgaaaatgcctatcacggtgagcagtaacaaaaatgtcatgttccagcacatctctatatccgtctctcactgtctcttcccccaaaatccagactgcatgtgaagaaaactggggcccagagatctcaagagactggctctacatgtctggctacctgagggtcatgttgggatttaaactctggtatctgaagaaggctggagcccttcctctctcccacctgttcccctcagtcctgcaatttatgccgtgcttccaggatctgggcaacctgctgctgtttccacttgctccagccaaaggtgtttctgcagcagggcctgctccacccttaaaagggttgagaaagagggacatggcaagaggaataggctggaacttgggcatcacatcctacagggggctgggcaggatcccgagtatcacctttgtgaggggtctggcccaggccaggatctcgagtgttctgacaccatcagcaatgggaaggagggaatcactggcctggccacacccacaccacctcttcccctccctcctcctctccccctccatatcccctttcctgctttgcagatctacgtcaatgcacagctaccgcttactcaagaagaataaatccaatgatagtcagttaaatatttgtgcttaaagggataattgcaaaaaaagaaaaaaaggcaaactcctgaaagttgttaaagtataaagtagatcactgggagaaaattgacagaaggcttcatgctcacacacaaatacataaaaatcactcactttgggagaaaactgtacctttaacaaaaatgttttaaattatgcattgtttgttctttccccctagactgcagaagacttttgtgaactatggagaggccacgatgtacggccttgaaacctgcccgaacacctggctgagggcccatgcagtgtggggaaggtagtagtcacagatgttgtagtagtaacaacaaaaatcatcatatcacttttctttatttctacttacacaggttttaaatgaatatgctcttattgtaaactatcaaacaatagagagaatcacctcgataaccccatcccccatctcactctgtacccataaggtaatcattgaaacctagttagtaaatattcctttagactttttttctctacatgtacatcaatatatgtgtgtgaatggaagtacataatttgctttctattttcttatacattacttaggataatttctgaaaatttgatttttcatctaacaatatatccctattttttcatgttggaacatataaatgaacctcatttttggggggggagggacagagtttcactcttgttgctcaggctggagtgcaatggcgtgacctcagctcactgcaacctccgcctcctgggttcaagcagctctccttcctcagcctcctgagtagctgggattacaggcgcccaccaccacgcctggttaatttttgtgtttttagtagagacagggtttcaccatgttggccaggctggccctgaactcctgacctcagatgacccgcctgcctcggcctcccaaagtgctgggattataggtgtgaaccacctcgcccagcctacctcattattttttaaggctcacagtgttccctagtgtggatgtatatccgtttcatttgcttattcccctaaggtgaacattcaggttgttccctgccttgataaaaagttaacggtgtacaaaatggttttctctgtcttagttcctctgttcctctcaacagccttgtgaggtaggcagggtgggtttttattgccctggaaatatgaggcttataaagataaaataacatatccaaaggcatggacattgatatgggtggagcagagatttgaccaagaacctaacattggagccttccccagcaaagtccctcaggaggtagtgagtcaaattgtggctgctaagattcctttgcagctcctctcttgggattctcagtaggtcattgatctcctgatcaggagccactctaatgattagatgaggtcatgagaaagagttagaaacatttaaaaaatatttaaagtaataatttgtcatctttaatttactgagagatacctgaggagcttgattaaaaactgcccattccttggccatgtgtggtggctcacgcctgtaatcccagcactttgggaggctgaggtgggtggatcacctgaggtcaggagtttgagaccagcctgaccaacatggcgtaaccctgtctctactaaaaatatgaaaattagccaggcttggtggtgggtgcctgtaatcccagctactcaggagactgaggcaggagaatcgcttgaactcaggaggcagaggttgcagtgagccgagatcgcaccattgcactccagcctgggtgacagagtgagactccatctcaaaacaaacaaacaaacaaacaaaagctgcccattccatggaggcaatggtcattaatggatgctcaagctgttagaggaatggtcactgggaagctttataaagggagaatgcactgatgctacctgaccccatgtactcatcttagcatctcatatttatatacatgacagctagctatgtgtgtctcataatagcccacagtagggagtacagagtagtaccacctctgatatttcaaaaataaatttgaaacctccatttattcaagccactagatctaatatccatttataggaagcacgggggatagaggaacaagataaatagcatcatgaggaagtcaccaaccaaatagaaaaaataggatatactacaggacaaatgatctggtatcttcagcagcaaacaaaaaattaaaagttgcaaggaaaaaataaacagggcaaggggaatgtagcagtttaaaaaacttaagagacttaacaaaatacaatgtgtagacttgtttggaaaccaactgtaagacagatatttttgagagaattggagaaatctgaatatggactgaatattagatggtataaagaaattattggccaagcacaatggctcatgcctgtaatcccaacaccttgagaggtcaaggtgggaggatctcttgagaccaggtgtcaagacagcctaggcaaaatggtgggaccccatctccacaaaaattttttttaaatagccaggcctggtagcacacacctgtggatccagctactcaggaggctgaggtgggaggatcacttgagcccaggaggttgaggctgcagtgagccatgactgcaccactacactctagcctgggaaacagagcgagaatctgtctcaaaaaaaaaaaaagaaattattgttaattttgtaagacatgatgatggtatgatgattatactttttaaagttattatctattacagctacatactgaattattattattattattattattttgagacagagtctggagtgcagtggcgcgatctcggctcactgcaagctccacctcccgggttcatgccattctcctgcctcagcctcctgagtagctgggactacaggcgcccgccaccatgcccggctaattttttgtatttttagtagagatggggtttcaccgtgttagccaggatggtctcgatctcctgacctcgtgatccgcccgcctcggccttgcaaagtggtgggattacaggcgtgagccactgcacccggcccatactgaattatttacaggtgaaataacttggggtctctggtttgctacaaatacaccgacaaattcagtatgtgtgtgatggggctgaagagatagagaacaagtggcaaaaagttcattgttgaagctgggatgagcacatgtgaattcatgaaattattctcgttaaattctcgttatattcattaaattattcattgcttttgtatatgtttgaaaatcttcctaagatagacagaaaaagatattattctgaagtcacatgtgacactgccaagattctgactcaataggatgatatgagaaccaggagcctgtatttttaacataggcctcaaccaacaaattggttgatactacaagccaattttgaaaagcccttatctaaacattataatctaagtaaaggaacatatttttgttcttttagaaaaatgcatctccaaatttggaataatttaagaacccaaaagaataatggcaataacagagtataagatattaaatttagaaataattaacatgtgtctgttgtgatgccaaaaaaaagaggagaaaacaatatatctctcttaaaaaccagctaataaatttagaagaaatgatacatagacttagaaaaccaccaccttgcaaccaccaatgattcaagcaaggaacatcagtgagtggtaaaaccattggtttgaggaacaggataatcatgccatctcaaagttttaccccacagattacaaagggaaaatgtacatttccaataggagatctggcagtcaccaacaaagcaaaacaacaggatatcatgtgcctcccaatatgatgaaatagaggtacaaaactatcacctctgtagtattcttgctaaaagtgctcccctgaatttaatcacgaggaagcaatcatacaagcccgcaatgtggggcgttctataagacaattggcctatactcttcaaacaaagccagtgtgatgaaaacacactgagactctgtctcaaaaaataaaataaaataaaataattcagtgtgtagctctaacagataataactttaaaaagtataatcatcataccatcatcatctcttacaaaattaataataatttctttttttttttgaggcagattctcactctgtttctcaggctagagtgtagtggtgtgatcatggctcactgcagcctcaacctcctgggctcaagtgatcctcccacttggctagagatgtagccaaatgcaatatacaaaccttcattagatcctgaattaaaaaataaaataactacaaaaggtactttagagagaattgggataatactaactcatttttatgtaagagacttgagcatctgcagattttgaatttgtaaggggtcttggataccaatgaatgagtgtatttaaaatagaaactgtatatatgtataaaatagaaactgtatatatgtatatatatgaagatattgaagttgattttctggctattgcagtcttaagaatttagggtttaagtattaggatacctacaattgactttttcttttttttttttttgagatggaatttggctctgtcacccaggctggagtgcagtggcaagatctcagctcactgcaacccccaccttcagggttcaagcaattctcctgcccaagcctcccgagtagctgggatttacaggtgcctgccaccacacctggctaatttttgtatttttagtagagacggggtttcaccatgttagtcaggttggtcttgaactcctgacctcaacgatccacctgccttggccttccaaagtgacctgcaattgactttcaaatgattctgaaaaaaattgcgtgtgtatgtgtgtgtgtgtatagacgaatattcattcgtctatatatacatatatattatatatatatgtaatgcaatttggggccaaaaattaacaactggtatatttagttaaagggtacatggatgttaattatactattctttcaactttttggcttaaaaatttttcaaaataaaagaaagtagggaaatttttaaaaataataacaaaaataattgtttcaaatagtaaacattcttaagaaataattttagcttttgtttcctccctctgtctgcctcttcctttccttcccaggtacactgtcagcttcttattagtcatcacccagctgggcttctgcagtgtttattttatgtttatggcagacaatttacaacaggtaaagagccctcttctgggcagagtgggggaaaagcagacctcctgctgctgaggctacattagcaaaagtattgtgttaggctcatgggaggagagaacttcatttctactcctagatcagaccacgcttgggagctctctcagtcctgggaatcacattttgaaaggatagacgagctaaagtaacttctgaagagtttagccagggtagaaagagaggcctgcaatcatgtccagtcagaaatcaatgataattgttagcctgaaaaacactggtgacatttactttgagtatctcaaggttgtcatgtagaagatgtctaactatacaaggacaacaagctgccaccttcccctcattgcattcctatcagacattacaaatcaaccacagccttctttcttggctttgtggattagagggagcatccttgtttttgcgcacccaaacagccagaaagaactgtgacaagtattgtagacggaatattcaagcagatggatactgaccaatatttagagcttcccagattttagggctatctaaatttgaagaggatattcttgtgtgatgaattccctttctctggatgtatgaaagaaactcattttgtggagaagaaaaggtttgagtagataacaacctcaaagccttgagattttatgattctaagggtttctggttgtcacaatcatgggcccgacagggttgcccaatttggcaaataataatatatgatacccagttatgatagaatttcagataagtagtgattttgttttactatgagcgtgtcttatgcaatatttggggcatatttatactaaaaagttacattaattacctgaaattcaaatgtaattggtgtcctgtgttttacgtagcaaccacactgcctgtcattgtgctttatgtcagatggtggaaaaagcccacgtgacctccaacatctgccagcccagggagattctgacgctgacccccatcctggacattcgtttctacatgctgataatcctgcccttcctgatcctgttggtgtttatccagaacctcaaggtgctgtccgtcttctcgacattggccaacatcaccacccttgggagcatggctctgatctttgagtatatcatggaggtctgtgccatagggaagaaaggatcagggtcctgggtctctgaaacacctggggaggagggtttgttatcatgatgggcaggtgaagctgaggaaggtgatcctctgctctgagcagcccctgccaacatgacatctaggaacacttctgtcccacaagttgtaaaagctaattattatcatcatcattgtcatcaacatcctcatcatcatcatcatcgtcacattggataataatgggtcattcaacaaataattactgaataccttctgcaatccaggcattgtgcaaggggccagggactcagtggtcagcaaaaataaatagggtgcctgctctcatggaagctgcatttacttggagagataaacatcaatcaaatcaccaaaaaaattgtaaaagtggtagatggacaaaagaaatacagatgataaaggaattttatttacttggtgccaaattatttacatacattaacttattgaaccttcgcaatactattttggaagtaaagctggcactctgtatccatgatttccacatccatggatctgaacaatcacaaatggaaactattgggagaaaaaaacactaaaaatatacaacaataaaaaatcatacaagttaagaaacaactaggtctaacaactattggccaggcacagtggctcacacctgtaatcccagcacttgaggaggctgaggtgggagggttgcttaagcccaggagttcaagaccagctggacaacatagcaaaatcctgcctctacaaaaaatttaaaaattagtggggcatgatggcttgcacctgtagtcctagctacctgggaagctgaggtggatggatcacctgagcccatgaggtcaaggctacagtaagctatgatcacaccactgcattccagcctgggtgacagagcaagaccgtctcaaaaaaacataagcatgggttatatgcaaatactataccattttatatcaaggacttgagcatttgcagatttggtatccacgggaggtcctggaacattagttctcccatggagaccaaggaacaactatagtatctttatctgcaatttacagacaaggaaattgataaagtaattctttcatgaatttcagactgcctcccatgtccatgctccattatcacagaccacgaaatcccaccattatactttcattttcttgagtgaaagtctctggggttgtattcatttcatattgctgctgtgataaattaccacaaatctagtggcttgaaaaaacacaaatttattttccagtgcttgagtctcgctaggttgaacttaatgtgcggcagagcagcattcctttctggattccaggggagaatctgttctcttgtcttctccagctttgtagaggctgtctgtgtgccttggctcaggccgccttccatcttcaaagctagcagcctcaagccaagtctttctcatgttgccttccctctgatcttccccttctgactccctcttccacttttaaggatgcttgtcccacccgaataatccaggatcatctccttgttttagggtcagctgattggaaaccttaatcccatctaaaaacttaattctccctcgccatgtaacataacatactctcatcttttggggattaggatgtgaacatctttggggaaccattattctacccaccatagaaatctattaacataatcattccccctagattcatgagagctgctatactaactagtggactgcacagccctgaaagaagtgtgggagagacatgttagagggctgggaaacaggagacctgaattcttatctgggctgtgccactaacttgcatagtgaccttgggcaattcccctctcctctgtgttccactttctccacatgtagagatgagcgggctcccagtagccaaagggtgggataatccaagagtccaagtaagtgatgaaaggatgaacacgatttggtgtctatatatagagtggaatattattcagccttaaaaagtgaggagacagtgacacataccacaatgtggatgaaacttgaggacgctaaagctaaatgaaataagccaggcacagaaacaatacatatgataggattccacttacatgaggtacctagaatagtccaattcatagagacagatagtagagcagggggtgccaggaggctgggtagtggggcgttattatttgatagataaagagtttccatttggggtgatgaaaatgttctggagatggataggggtgatggatacacaacaacgtgaatgttcttcatattactgaactgtgcacttaaaatagttaaaatggtaaaatgttatgtgtattttagcacaatataaatgaataaatcatcatatttaaaagattagaaggctgactgaggtctaggtatcttctgattttctctgttgagatcaggtgtgacccagctttctaccaggcaaagatttgggatgacttcgacaccataacaacaccaatgtgcttctcccactttcttttaggggattccatatcccagcaacctacccttgatggcaaactggaagaccttcttgctgttctttggtacagccatcttcacatttgaaggcgtcggtatggtaagattgatggggttcacgcgaatggtccctagcgccctctacagtggccaactgtagttgcagatgtctgaataaatagtatttatgaaaaggtgcagactctgatcttctcctggtgaagggaaagtctgtacccacatacagggtccctactgctctaatataccacgctaagcattgaagactgagaatttactaatcaaccaagactaagtagggcattcctgacaatagaaagcatgagagaaaatgaaaggagtgtggccatgtggagagtcccctttctgatactgggcccacctggggaaggacatttgtgcttgtacgggaaccctctccttcacaatgggccacatctctttctaccttttctttcccaacttttttttttccctccaggttctgcctctcaaaaaccagatgaagcatccacagcagttttcttttgttctgtacttggggatgtccattgtcatcatcctctatatcttactggggacactgggctacatgaagtttgggtcagacacccaggccagcatcaccctcaacttgcccaattgctggtatgtcctgcccacctcaggtgagatagggagagacactggaactgttctggttgtcatagcagagagcacagcaaagctgagccatgaagctggtaatccatcactggaagtgacatatgtctctcctgctcacactgcatcagtcaaagcaagccacatggccgcacctcactccaagggggcagggaagtgcaattctgccatgtgcctggaagtatttggtgaacagcacaaataactgctgtgctacctgatgcagtgaccgtggggattaattggattaatacatagataatgcttagaaaagtgcttagcacgtggtaagcattcatgagcgttagctattatcattgttatgcatccccacagccttcatttttccaaggtgagtaggatgatggtgcatttatttcccacaaatccagagctgtagaatgagaaaaatgtaaccatccccacccaccttgctgtgttatgataatgactagatgagacaataaatgtggagtttctttgaagttgtgccttattttactcaagatatcatcctaatatgctgttcttgttctgggcaatttgggctgtcactagctgccttggacagggcactttccttcctgggacctcagctagaaaacatgggtgttgagctccatcaggacttcacacctgctggtgtgaacctcactagtcatcaggttctccaggaaagccttaaacaaatatcccttcccaataagaaaaagaccaaccacccaatgagaaatgggcaaagggcagaacaggtatttcacaggcaaataaaaaaaaatggccagatggccagataaagagatgctcagaaagatagtagaaggccaggggcagtggctcatgcctgtaatcccagctctttgggaggctgaggcgggtggatcacctgaggtcaggagttcgagaccagcctggccaacatggcaaaaccccatctctgctaaaaaatatcaaaattagctgggcgtggtggtgtgagcctgtaatcccagctactcaggaggctgaggcagaagaattgcttgagcctgtgaggcagaggttgcagtgagccgagatcacgccattgcattccagcctaggtgacaaaagcgagactcagtctcaaaaaaaaaaaaaaagaaagaaagaaagaaagataatagaaatgtgagttaaaaaataaatacaagggcaaagatgcatgcatcgacacactgtttaggcaaggacatgggaaagcaggtctttttatacactaggacagcaaatgggcaatatgtcaacagctattaaaattttaaatcatgtagacttttacccagcattttaacttctaagtttttatattatatgtgcattaatatatgtacaaggatagtctgtgcagtattgtttacttgggaaaagtctaagcccaatctaaatattcattaattggtgactgatttttaaaatgattgcatatccatgcaattgacatatcaaccagctattaaatagaagagccagatctatgtgtactggcagggaacaatctttaagacatactgggtgagacagccaggcgtggtggctcatgcctataatcccggcactttgggaggccgaggagggcgtatcacctgaggttgggagttcgcgaccagccagaccaacatagagaaaccccgtctctactaaaaatataaaattagctggacatggtggtgcatgcctgtaatcccagctactcgggaggctgaggcaagagaattgcttgaatccaggaggcggaagttgtggtgagctgagatcgtaccgttgcatcgcttctcagccttttggctaagatcaagtgagatcataccattgcactccagcctgggcaataaaagcgaaactccgtctcaaaaaaaaaaaaaaaaaaaaaaaaaacaagaaaaagaaaagaaatattgggtaaataaaagaggagtctacatgtgtatgtgcatatgtgtatgcatgtgtgtgtgtggatatgcatgtatgttcctacattctgtatgagcatgtacaaacaccaatcatttctagaagggccacaagaaaactctgaatggttgcctatggaaagggaaactagaagctaggaatcaagggtgggaagaatgcttttcactgtatgacttttgtaccatgaattttactctatgcatatattgtcttttttgtttgtttgtttgagatggagtctcactctgttgcccaggctggagtgagtgcagtggtgcaatttcggctcactgcaacctccacctcctgggttcaagcaattctcctgtctcagcctcccgagtagctgggactacaggtgcatgccaccacgcccagctaatttttgtatttttattagagacgagctttcaccatattggtcaggctggtgtcgaactcctgacctcaggtgatccactcgcctcggcctctcaaactgctgcgattacaagcgtgagccaccacgcccggctattgtcttttaaaaaattaaaaaagaagaggcatacattcctgagctgcaggcctactgactcagaatcttcagcaataagcacttttaataagcttcccggatggccctgatgtccaatctggcctgaatcatctaacattagccagttctataattcagtgaaaagtacagattgagtaacccttatccaaaatgcttgggaccagaagtgttttggattttgaagcatttcagattttgttttggattagggatactcaacccataccagcttctgagcagtaagtgagtcctcaatggcccttccggggagccacatcacctttcacatccaattcatgtgtctgcaggttgtaccagtcagtcaagctgatgtactctatcggcatcttcttcacctatgccctccagttccacgtcccagctgagatcatcatcccgtttgccatctcccaagtgtcagagagctgggcactgtttgtagacctgtctgtccgctcagccttggtctgtctaacctgtgagtagcataaaagggcactctttacccaaagctatgacagggagccacgctggcgcccaccccaccatcattggatctgccacttgccttctttgtgacctagggtgggatatttcacctccctggacctcaatttttccacgtgaaaaaaaagggcttaacagaattaccacacagtaaatgttatagtcgtctctactgcctacacatagaaaatagatgctggctggtttgtagaagaagtatcattcattcaatcctatatgtcaggcaccgtactgacattatccaatactgatgatagcctaacaatgtattaccattagagggaactgtggcccagataaattaagtaacacacctgagtcatacacactaagtgacaaagctgggatttgaacacagattgtgtaacaactgtttttcatggtgccatatttcttcttatcataaattatgaacaagtcctgtatcataaagtgagatttaactgtagggaaaaatcccagtgggactgatttgtcagtcttggagattatttatttatttatttatttgagacagagtctcgctctgttgcccagactggagtgcagtggtgctatctcggctcactgcaacctctgcctcccaggttcaagagattctcctgcctcagcctcctgagtagctgggattacaggcacctgccaccatgcccggctaatttttgtatttttagtagagacggggtttcatcacgtttgccagctggtctcaaaatcctgatctcaagtgatctgcctgcctcagcctcccaaagtgctgggattacagatgtgaaccatgcacccagccagagatcattttttggctgtactcttctctcttccctcccttcctttcttcctgttcctttcaattcattcattcactcactcatgagcactgttgtagtgtttgggaaacctcatgaacagggctggggaattctttctttggaacatgtctagacggaggatcacaaacgatgacccatgaggaatgagcaaaacaacaagggatgttttgcctggagaagcaaagtctcaggaaatttccacatttatccttaaacacctgtgggattattgtaaaagtgaagggagaaatttagtcttcaaggctccaggagtcagaatttaaagtcattgaaggaatcaagtttccgtacggggtcaggagaaactatgcaatgcttggagctgtgcagcagaacatactatcagataataagctttaaatggcaggcgttctatgagcagaaacagcaaaatcctacttggtttgaggtgttagagttcccagtctgtgctgagacatcaggaagctgtaaatagtattgtttgtgatcattcctactaggaagggtgtaagttgacaagaaagactgaggagcctctgagtatcagggaatgcatgactagagacagttgaccttataatgacatgtcctgcttttgatatatgctgaaagtcccattcttcatccattattcatccatcaattctattaccctttaccctttattcattcaacaatcatttgttgagcacctactacatacctggcattgtgctagacacaagggatacaatgatgaataatgaagaagatgtagcttctgccttcacaggacctacagttgagtggcaaatatatgcaaggaaataattacagtgcattgcaatgattgttaagatgggacatgataatgcaccatatgatggttaagatcgtaagtagaagacacactctacacataagggggtcctataactcagcctggccgagccagggagtcctctccagtggagtgacacttcagtgaagacctaaataagtagcaaatagacggaggagtgaagaatgtaccacgggaagggaacagactgtgcacagacctgaggcaagtattgcctatggcccctttggagaagtggagagtgctgagagatgaggtcagagctttgtcagggccaagtcctaagggtcattgtgctgaggagtttgggccatgcagagccatggaaaggcactgagcagaggactggcatgaccagaatggagcgtaaggcctttctccattccaccttgaattatagcttttcttgcatgtatcttctctgcctcctcgttgtgagctttcctggaagactgatgctgagttttctctataagcggcttattaaacattggatgaaggaaagctgtggacagggacctcccatcgaaggagaatgcactcctagccatgagagtctatgagtctctcttatgcttggactggatgtgtcagagcaatttcagaaagaggtgatttttttaaagatccagcaagcttgtatggatgctttccagaacaggctttctctattttgttcataggaaaatcatatgattggaatattttaagtaatggatatcccaagtacactgatttgatctttactaattatataaacatattgaattatcacatgtacccccaaactacatacacatagtatacatcaatgtaataattgttttaaaataataaatttgcataaaattaaatcatataaattatatatttactcattcaaacattattgaaattggactcccttggaaaatctgtgatactatatgctcatcatgtgtataagagatggaattttaggagtgtgaagagaagagaaggatgggggttggatagcttaatgctgtctttgtgttttatggcctgcttcattactaagatcctattaagaatagaaaaataagtggctgatattcggacagcagcagaagcatctcccatttttttatccatccttgcttctagacaaaggctatattatatagatactacaaatgttggttctgagcctgggcaagagtcaagcacttattgagcatctactgtgtatcaagttctttcttacacatgagaggcagcatagtagagtgaaaaggaccttagatggggcatcccagtgaattctcatctcagctctgtgtgaccttgaacaagtcctgttccttctagagctctagatttccccatctctacagtggggaggttattaacaggtaagtggtagaagagcccttccaataaagattatatgtaaaaaaaaatccagtagataaaatataaaaggagagcatctatattactagttaagacaggggtgggagttgcctgacctccccaagcctgcagtaggctccctcccacctctccaaagtggtctctcaggtgtctgtgaaattctagggctccaaagcaatggcttgtttctgagcacattcagtgattctaaatatctcctttcattgcaggtgtctcagccatcctcatcccccgcctggacttggtcatctccctggtaggctccgtgagcagcagcgccctggctctcatcatcccagccctcctggagatcgtcatcttttactctgaggacatgagctgtgtcaccattgccaaggacatcatgattagcatcgtgggccttttagggtgtatatttgggacataccaagccctctatgagttgccccaacccatcagccattccatggccaactccacaggtgtccatgcataattatctgtttttattctaatagctctcccttcctcccatccccagtttgacttccatgtggatgttatataccttcatcaaatcccaacatctctatattaattagtggcgtctttatctttccaagagaaatgcagatgagaaaagttagcactgatgtctctcaggctacacctcttttggttttatattttttggatggccttttgtacctctgaaccaaaattagattcaactattcatattatcagcctcattttatggaaaagggatgccacttaccccaatagcccttgaaacagagaccaagcataaatacaaaagtaactgttttctctacactgcagtagctgcccttaaagcatcagatttagaaaagtgtatgttgggcgaagggagttttctatttagatattctaagtagaagagtcatagacagaacaaaaacagaactcagcagtaattttgtccaaccactggctccgccactgatttcctactggccctcaggcaagttcctccccatctctcagtctatgaagtgaacagttggactaactgattattaaggactctgtcaactctgatattctgaaagtgaataaaagaaattaacttatccaccaaccacaaaaactggccatgctagtgttggtgaggaggtggagtaactgaaactccataccctgctatgtggatagaaagtagtacaatcagtttgataaacatcttgtagtttctttaaaacttaaacatatacctaccatatgatccaactattccactccagaaaaaagaaatatatatccataaaaagacttgtacaaaaatattcatggtaactttacttataaaagcaaagaagttggaaatactctaaatgtctataaacaagagaatggataaataaattgtgatgtagccatacaatggaatattcctcagcaaggaacagaaacaaactgttgaaatacacaataaaatgtatgaatcttaaaataaatatgctgaatgacaaaatccagaccaaaaaaagaatacaaactggatgattctatttatataaaagcctggaaaatgaaaactaatctgtagtgacagagaacagctcagtggttggtgcaagatgagatgggtgagagggaggtgttacaaaggagcatgaggaaatttttggaagggatggataacatgttcactgtcttgattgtgaagatggtttcacaagagggtacatatgtcaaaacttatcaattggatacttcaaatatgtggcatttattatatgtcaattatacctcaataaagctgttaaaaatagaatatgaaacatgattccatttttattttttaaatcagttacacacatacagtcaaataattttgaatactcagcacattgtcataggaatttttcaccaagtgggttgaattatgagtaaaatcttacactttttattttatgtatttatatatttttaaaaatagagacagggtctcactatgctgcccaggctgatctcaagcccctgggctcaagcgatccacctgcctcggattcccaaagtgctgggattacaggtgtgagccactgtgcccagccaaaattttatactttttcttttgcttgcctatgttgttgcatttttaaaaaaaataatgcactgatttcataactaaagaaaattcattttaagggggaaagtattaatgatgatttgtttcactctagaagaaatgccacctttaaaaagctttttatttaaacaccaatgaaagtataactctacagtataattaatatttgtagagagtatcaattttcaacttcaccttctattagatgattgatattatggcctgaataacaggcatttcagctggagttagcagcattccccctctgtaatgtatcgtccatttaccaatggtcagatgccaaacaacagcctctcagaggagatgtgaagtagctgtgttatcatgaaggagaggtagggaagaatatcctaccgctagatagaaagctatcagcccataaaaagtttctgctcttttgggatccagaccatgaacttggagaaggaaaggctttgaggaacatatggaaaccttactatagaatatggagcaattaaacggaggtaaggcagctgtttatgatttttggggacttatgcagctcactgacattctaatagaagctgtggctcctccttctataaaattcacatatatgcataagttttgcatgcagtttctgaaactatcacaaacctcatgaagtgaatagaccctgggttgcaaaagaacctctggaaaaaaaaaaaaggaatgtaaggatttctgcttctcatacatgaaatgatctgcagatgatagatagccaaccctggaacaaaggtctggatgcagaatagagcaatatacaaaaatcagatgagggaggtaagctatcagataagagatcaccatgtaactggtatagaaaacactttctgatggcagtcagcactgataggacccaaactggtcattccagttgtgcaacacaggctgaattctctgctgccacatgcttctttggcaaaaactgggacttatgagttgaaacagagagatctagaaggatacaaagaatgtgggaaggtcccccaggaccttcagaatcatttgccactgtacttctctactggacaaatatgatttatcttgacatgactgagctggacaatggttggggcataaagggaaatgatatataaaatcaatcagtttaagaagaagctgaattcagatcttcaacaaggccattggaggccaggcacagtggctcacgcctgtaatcccagtgctttgggaggctgaggtgggtggatcacctgaggtcaggagtttgagaccagcctggccaacatggtgaaacaccatctctactaaaaatacaaaaattagccaggtgtggtggcaggcacctgtagtcccagatactcgggaggctgaagcaggagaattgtttgaacacaggaggcagagggtgcagtgagccaagatcatgccattgtactccagcctaggcaacaagagtgagactccatctcaaaaaaaaacagaaaacaaggccattggaaaaaaaaaagaaatgggagagttgagattgctaaggaacacaaactgagattgctaagcacgtaagccctacaagtgtggggctagagaagtcacccacgtgaaggtgaagccttaagagatagctacaaagtgatataagtcagtgcacaagtgcagtggtttataagccacagtgccctgggaatggaactgacaggcagcaatctaaggatctataagacttgttatccgccaagtccaggttgtgcctgtctcaaacccacaaaggagctccttaagcaattcccagatctgagttcaaaagggaagaaaaagggggtggggagcagaacacctccctggcatgccaaccccaattgcaagtgaaatttatttggcaagatagactctctcaagggaaaattctcaggtggattcaaacttaggaagttggcttcctggtcagggagacatgggtgaaccaaaagacttctcccgggaggccgaggcgggcggatcatgaggtcaggaggtcgagaccacggtgaaaccccgtctctactaaaaacacaaaaagttagccaggcatggtggtgggcacctgtagtcccagctactcgggaggctgagaggagaatggtgtgaacccgggaggcagagcttgcagtgagccgagatcactccagtgctctccagcctgggtgacagagtgagactccatcgcaaaaaaaaaaaaaaaaaagaaaaaagaaaggcttctccccacctctccagcttcttcttgccccaattacaccttttccttccagccacaccaaccagcctttgtccagttccgcaaatgcaccatgcttcccattgctgctgggcctccatctacgctcttctcccatctcttcacctgcttaattcctcctcattttccagatctcagctatcacttcctcaggaaaaccctttctgacctcagccactaacccagattctgcataaatgttcactcccttctcctgtactgcagttacatgatggcaggttgtgttggttaatactgagtgtcaacttgattggatacaaagtattgatcctgggtgtgtctgtgaggatgttgccaaaggagattaacatttgagtcagtgggctgggaaaggcagacccactattaacctggatgggcacaatctaatcagctgccagcacggctagaatataagcaagcagaaaaatgtgaaaagagagactggcctagcctcccagcctacatctttctcccgtgctgaatgcttcctaccctcgaacattggactccaaggtcttcagttttagaacttgggctggctctccttgctcttcagcctgcagatggcctattgtgggaccttgtgatcaagtgagttaatacttaataaactcccctttgtatatatttctattagttccattagttctgtccctgtacagaaccctaatacaaggttcatatctttttttctcaaaatgaaaacttctgcaaactatttttaaaactttttattttgaaaaaagttagactttcaaagggtggcaaaaataatagtttccatgtacccttcacccagctcttactaatgttaacatcttacataaccacagtacaattatcaaaaccaaataattgacattgatgaaatcttatttctggtcctttttctaatccaacatctaaatcggtatctcacaatgcagttagttatcatatttctttactctcttccagtccatgactgttcctcagtctttccttattgttcacggccttggcactttcaaaacgtactggccagttattttgtagagtgtctctcagtttgggcttgtctgatcttttctcctgattgcactgagattgcacatttctgacaacaccacagaagtgacaattgtgc

SEQ ID NO: 11 - DNA, 77992 bp, Homo sapiens
  misc_feature (25026)..(25026): n is a, c, g, or t
  misc_feature (34205)..(34304): n is a, c, g, or t
  misc_feature (36809)..(36908): n is a, c, g, or t
  misc_feature (39455)..(39554): n is a, c, g, or t
  misc_feature (40803)..(40902): n is a, c, g, or t
  misc_feature (42813)..(42912): n is a, c, g, or t
  misc_feature (43974)..(44073): n is a, c, g, or t
  misc_feature (45116)..(45215): n is a, c, g, or t
  misc_feature (46542)..(46641): n is a, c, g, or t
  misc_feature (47926)..(48025): n is a, c, g, or t
  misc_feature (49131)..(49230): n is a, c, g, or t
  misc_feature (70204)..(70303): n is a, c, g, or t
  misc_feature (76568)..(76667): n is a, c, g, or t
aatgctgctacctactagttggtggcttggcgtagctgctaaatctctttgaccttcctgttccagaaatgataatgacaacgaaaatagtcagactacatgcccaccttcctctcttggtaaaatgttatactttaagagtattctttgaaggctctgttttaaaacttatactggtaaatgtattttcctgagttctatgagctactctagcaaattaattgaaccccaaaacagagtcatgggaaccctgatttaaaatttttagccagtcagaagcacaggtaaacaacctggtacttgcaattggcactggaagtggtggtggtgggggtgtcactcttggggactgagccctcgtcctgtgggatctgatgccatcttcaggcaggtggtgtcagaattgaattggagcacacctggctagtgtttgccgcagaagtgattgtatgcttgctggtgcgaacaaattctcaagtattttggggggcggggaaatgtattgagtgagagaataaacattttaagccttaagtgtgttttcccactcagtgacaaaaaggtaagggaaggggtgtcatctcttccattgtcctgtcctgaaattaatctccacatttcaagaaaattaagtgttacctgttgtgtccggtttcttcagagaaacaaagccagtaggagatatatatatacacacacacacacatatgtgaacacagatacacatagagagactgagagagagacaaatcaaggaactggctcccatgaccgtatgagccggcaagtctgcgagtcatagggcaggcctgtaggcaggagctgatgctgcagtctggaggcagaatttcttctccaaggaaacctcagctttgttctaaaggcctttatactgattggatgtggcccacccacaatattgagaaaacctcttttacttaaaggcaactgattatagatgttaaccacatttacaaaataccttcgcagcaacacctggattagtgtttgactgaattataagttgacacatataaaactggctgtcatgtgggctcatctgctatgcaaggagagggctgaaaattcttactcaagttttcgagagaagcaggaggaggtttagggaggggaggattgtctaacagaaaaaaaaataaaaaaccattcctagtccgtttcttcttgggcgactcttaattccatggatgggtctactgcttgtgccactttgccatatgaactctgtggcataagccggaaacatttaacccagtatctagtaaagggatctgagtgatataaaaagaaaaaaaaaaaaagacacagatagcaacctctcaaaaataaaaataaaattcatttattaaaaagaaaaagcttaacatacgatccatgtgcaaaccccaaaacaggatctacgaactctggcatgatccacatcgctacacataccatgctggaagtgcacatccacacaggcacataacatacacagtactgtctagttatcaacacctacagattggttgatttttcttcacacaccattgacatgttttacaatagagttaccaattttattatccactgaaagagcatagcttcccccagaatcactttgatttaaaccaaataacacagtgaatgacaggcaccctgcacctatatctgctaccttccttactctgataacctcctaccagcaccatttatgtcctctggccagggaacgactcagtggcacaaaggaaagagaagaaatgttacaggctgatgctgtcggggcaaatagccctgcaaccagccggacttactgtctaaaagtattaaccgtaatttcaaagacaaaccacaccccttccttttcccctaatggcctcagagatttgtaatgtactttggaaaattaacttctaaggcagagtggaagccaacctcaagtcctgccacttggactctgtgtcttctcttcgaggaagcagcattgtgcacccagcgggggcagatgctgaggcttgccttaacatctcagcagctacaaaatgaaatccactgatacagaaccccttgctgtgagcagtgaggagagagagctgtaaacagacacaaattgagatttttgcacttccaaaaaatacgaggtgaacattagtgctaaacagagagaatgttctaggaagggagaaatctgagaagagaaaagtaagatgagagagaagaaacatgatttttctaatgtacttgtttgagatcaacactttaagactactgataaaactaaatttcgtggggatagacagtgagcagtgagcatcagccagtgaatctggctgcagaggagagatggaattgggcggctgaagtgaaatgatgccacacattcacacatatctagccagggcttgtgcagatgaagggatcttagcagctggacagcagcacaacataaataatgccacttgtgaatggtgacaactgctaggcagggtgaacagaagacgccagctcacactcttcctagcaagtgcctgcatttaggaggaggtgcactgcccactgagagctggaagcccgctcccaacagcagcatttggaggacagaaccaccaaggggctctgagaaagctacctctggcttggagaaattggggtgacaggagcagggtcacagagcttaagagtatctggccggaaaagcccacggtttccctttgctccagcagatgcagcctcacactcccgaaagcctttgctccgttgctctgtgatcatatttctacttatcctgggaagacactggggagggctctctacctcaagaagccctttgggctgcataagagattctgggctggctgcgagctgcttgcataagaggaggaagggcttcctcccactactactgactggctgaccctttgcttgatgcctaagagctgtgcacctgcatagccaggaaggtcctctggctggagctgcccttcctgggtcttctgaaagagccacgcaatcagtctgtcagtgtagcaggagcacaagccagagatcaaataggccatgccaaattggcttccagaaatcctaaagctacagccaactctcctacataccacgttctcacggccaggggtgtggaagcaatagcctgcatcctgctaagagctgggggaccccagtattctaccatccagtcctcaggtcccaacatcacagtcccaatctcagaactcggatgggcaggatggtctctagcagctctgagtaaacagaaacgtccaccaaggaggacatgggcaggacacaggtctggccctccagttggcatctaccttctcactgagaccactcttagcaccgctgggaaagacagctaagatagcggctgggctgccagagcccgaacttggaaccaggagatgacagtttctgagcccactttggtaacttctaagcctgagacttcagaagacagggcctctgctactcccggctagattcctggtcacatagcacctgttaagagtccaccatagaacagaaagggtgggtgaaaatcgtccttctcctaaggaagaacaagtcaacaatgatagcatattcctaagttaacaaattattaggtaggttgggagtcactacaatgagagtccacttttcccatcccttcacctggaagtcagctctcctggctttggaacagaagagacagaaaaaactggggccatatgggtgggtcacagcccttatgagctttggcgaaacacagaagcaaaacccctgatacatttttgctgctctccttcaaccagctttcagagtgaactgtatctgcagtgaagcaagagcctggtgacgggacagaagagaaaaggagtctggtctgttacttacacaggaacacacacacacacgcacgtacacacacatgtgcacaaatacacagctaaagagggggaattcatcaatggccttctgaaatacttcgcacaccaagaggaaagaagaggcagcccacagcaaggcaatgtatcttcctctgccttctctgaagtttgctcccaaatctgaaggctgaccttgaggagggccaacctcaaggctgtttgtgaaacccagggaggcattctgggggaaagacagggctcataattagtgttcagtgggttcctttcaaagtccaggccacagaggcagtgtggggccgggcactggttctgcccttttccccactgattgtaaacaaccgagcactgcgcgtagtgtcagaccagctgctgtaaagtctattaacttaatttcaaactctgtgcacactgacctcagctactcatcggtggcaatagagctggtgtcgtcccagcacgatggcaacagagcattgctgatcctttcacctggcgtgggctgaggctgaaacatgggcctgcatgcacacagccccattttatacgcctctcactcagccacccttccctcggcccggtgcacccatacatttctgcagtccttcaatgtcttttcggtatgaaaccaggctggtcaacaggaggcaaaatctgtgcctcctcaccgaggtacatttttagacgatcctgattaaaacctttgagtcctcagccaagagtgccgaggacccatgcagacatctggagcgagcttcttttcagcaggagaagttgagtcaaagtttactgaagaagaagtgattcgtaatagccccagatctaagacagtctaaaaacaaaaatctgattttaaataaaagataaatattttcagtttaggcaacacttcgtatgttttaagagctaaagcaactaagaacacagtactgtgacccacactaaggaatccagggaagagaagcattgccttaggggtcacagcaagccagagagtccagattaaaaactccagcttgggggcctgtttcaaatgaccaggtaggttcagccaccccctggagactcgaataggaagaatactgagatacaacatttgggagagagatgagaaagaagcccagctttataaagagggggcgttcccagttacttaatctatgcctggcccagaaaaggtgaaaacatgaggtgggggacatgaaaattgttaaataaagtgaactgtgcagtaagaatgagttgggcgaggtgcaccagcagaggggaggcaggtaggaaggaggaggcatgatgagggggagctggaaagttctgggtgtaaataggtacaggtgagcgatggcagccctgtcactagtagcacttctgcgtgtctgccaccccacctctcccctgccctcaggttacctggcccagggtatccaggtgccaggcagaggggttcccacacagcaaccctgactttcctcagagcctggaccatacctgaggctctgaggacaggtaacgggggacacatggggcaggggtaggcagctgcagagacgaacccagatccctatatgaaggcacaggtggaattgatgaagatgggagcattgcttggctggatcagctcatagagagcctcataggtccccaccacaaagcccacgaagcccaggatgctgatcagggcgtccttaaagatggtgagggggctcatgccctctgagtagaaggtggtgacctccaggagcggtgggatgatgagggccagggcgctgctgctcacggagcccaccagggagatgaccaggtccaggcgggggatgaggatggccaagatgcctgcagggagagaggacatgcctgtttaagatgcccagagctgggaaaggtctgtctccctactgttgagcgaattcagcatctgtccatcttataggattgagagctctaagaaaacttagacattgtccagttcaatctctgtgaaatagatgcccagaaacgtggaataactggcgtcccactgcaaggtcagcagaactgggaccggaacccggatcttctggctccggtccccaggctttcagcttttccggctacagcacatgacttccatctttctgtgcaaaaggaaccaaattacatttcaggtcaatctggtttctacccaaggagggagggtagggagaagaaaaggaggtggacgttcctgagcagctgctcattttcttaccactcagggagcctccaacacaaacatctctacctgactgacaagaaaccaaataggaaaagaaaccccgccttctggaaagacaccgtgataaaaccgcatttcacagagcattttgatacaggtgaaaaaaagcagttctatctgcaggctgacccctggcgaagccccacacgacgaccgtatctctgtgacaggacacccactggctctcacatctgaaactcagccacgggtgagcgaggaaggaggaactgacgaagaccaatggtgcactgccgcaggaggtgccatcggcttccgtgccataccagccattgtcaacactgccagacagtgctgtaagcaggaggaggcttcaccgaatacacccatcctagtgcccactgaccccacgcttcccatctcaccgatctttccaccaggtgggcaaaggccagtgtttcacaggtttattgaggcctgtgggctctggaactaggttcttgtgttcagatcctggctctgctgctaattagctgagtgacattggggaaggtatggtacctttctattccccagttttcttgttggcaaaatggggatattaactgctcctgaatcatagagatgtcatgatggtcaaatgaggttatgcaggtgcctcacaaaaggcctggtgtacagtagggatgtcttacctgttaatgttatcatcattagtattcatctttttggccatgaaaagtacatcctgctacagtgcatgacttcctgttagttactaacctgttagcaatcaaatatagtttgacagattgtctttcctactgctgggctacagctggatgctcccagccttgatacagacatccagagcttatctactacctcattgattcctacgagagggttacattttatatgagaggtttgcttctaagttcattctgtaaagtgaaaatgcagtcaagtcactctaaggaaggcaccacactggtgagactgccagaacatctcagtccaaggcagccaatgtctacatcgatcactgcttctttggctgagcacctgaaggattggattgcatttagagaccagatttttaagaaacactttaaactgaaatgtctaaagttgatttttgaggagccataaaaacaaacaaaagagaatagcactccctgcagtaagatgagagacatgtggaaacaaggacttaccaggtaatatggtttggatatttgtcccctccaaatttcatgttgaaatgtgatccccaatgtcagaggtggggcctggtgggaagtgtttgagttgtgggggcaaatccctcatgaatgacttggggccctccccgagagagctgttgtttaaaagagcctggtacctcccttctccttgctccctgtcttgccatataaagcctgctccccctttgccttctgccatgattagaagcttcctgaggccctcaccagaagcagatgctggcatcacacttcctgtacagcctgcagagccatgagccaaaataaacctcttttctttataaattacccagtctcaggtgcttctttataacaacgcaaatggactaacacaccagggaaagaatggattcatgcctcctgcctcacacttaccctggagctgtgctgtccaacatagccacggacggctatttacattgaaatgaattaaaatgaaattaaatcctgttcttcattcacactagccacatttcaaaggctcaacaaccactggtgcctagtggctgctgcaatggacagcacacacatgggacatttccattcatttccattactgcagaatgtctagtggtacccagcagagagcactgctaagcactcactagtggaggtgaatctgcctctgtttcacaggtatgtaactccacaatattactacagtcctatggaaagagaggcccagagggtgtaaacgacaggaagcaacagagctgggaccaggatccaggacctcaagcccctggcccataacctcacagacctgatgggcaaggaaatgcagagggaggggagacagggagtctggcggatcagtggaaggatcctgcctgtgaggaaatgagaggtagatacccaggctagctttcacagggatgcaccatggtgcatggtggagaacccagcacacgatcagccctgacctctttctgctttgtcaagtggaattggacaagggatccaaagcctgacagcaaacgggtacaaggatatcgagtctcagatccacctctgccacagtgttatatactctggggcagttcttcatctttccttcttctattaatcaaccataatggcaattctcattaacatcttcaccgatctcaaggctttgagaagtgtgcaaaaagtttaggcttttaatttccctgaaactcaaaactactatgttttcagcccttagctgcttctaaatagagttggtgacatcccccaaaccttgagggttgaatatggagaaaattggaggtaaaattgtaggctgatgacaaaacagcattctcatcataggtcatctaacgctcaacaaaagagctggtctgctgtggtaccgacaccaagacacttgccctctctggggtctgggtctccctgcctaatgtcatccttgcagtgatggtgccaggtgttactgtggggtggaagctgcactgaggtaacaatcgggagaactgagccccagggagagggtggtataggaatgggtgtaggctctggatttggaatgcccaggctccaacctcagctctaccactcagtggctagttacctaaactctttgagactcatttccccaactactaaacaggatggtcaaacgatatcactcatgtaaagaactcagcgttctaaaaaccaataataaatgcttcaatattatcaccagtccctgctccataacaagctgagtggtgcagggcaaatcagcttactattctgagcctcagttcattcgtttacctgtgaaatgtggtaactgggtgatgtctgaagtctcgcccaactctgaaattctaaggaactatacactccagtgttagtcacttaggactgtgttctgggatatgttcctcacctcactgacaactgggaagcaccacgtcctgcctgagggtggcacagcaaagcgatggggctccaagcctcgaacacatggcttgcccaaaagggagcttctaacccactcggttttgtatggataaaggaagtgtgagttattccttcagtcccagccacacaagcatctccacaaatgctgatgtccgctcaagagacaggaggcctttattatcagagaaaatgagtccctggcaggagacaaatcagagcctttcccagccctgagagtctgtcatctccccaccctctcccatactgacctagcaggacatatgggcacttcatgatagttaagtggagtcagagagatgctccactctgtggtgggagttaagtggaaacagaaacagaagattgggatcagaatttttcctctgattggacaaagatcttccgcttcatcatgatattttataagtaatctaaaaacttgttcttgttttcaccactatataagataaacatgcctaataaaaatatccttaatagagattttaagaacatttctctcctcttaaagccaggaccacagggctgcaaagggaagtccttcttcctgtcctagctgaaccacataccaccgctgaaccctacatgaagcgtgacactgcagagggcaagaagagcgagcctcccactaacacaaagtgggaagaagagaaggatgtccaaaccaaatcagcatcagcagcccccagggttcaacagcacgggtatctgttttgccaccatggaaaatgactttaactaactccagaagcagcaatcgactatgcagacatgtggggcaaataaaaccccttctggcactaaatgtcttctgtgagttaaagtgcctatgaagagacactcaacaaggtagatatctcaggaagcagccagccaggaacagccctctccctactctcccctaatcccccccgcccccacacacaaagaccccagcccagacaaaaaggaagacatttgtataacaaatgcagttatacacttctcagcagcagctcagctgtggcgtgtacaaaaggggggacagaggacaacctcagctcgaccacatgattagtcaagagggctccaacagtattacaaaacatcttcccttcgagtcaagagacacaaagaatatgagcttttaaactgctgaagcaacataaggccaacagtcatgttcacagaaggaactggattctggagcctgtggttttgaaccagcatcagaaagagctgacttatacacaacaagagcaaagcactgaaaagaacaaacgcgaacttacgaaatacgctggccatttatggctcctgtgctgggagctcttgctgctattttattatgatcaaagctgttaaaacttaccaagttacttttatttatttatttttatttttatttttattgtttttgagatggagtctcgccctgtcacctaggctggagtgcagtggcgcgatcttggctcactgcaagctctgcctcctgggttcacgccattctcctgcctcagcctcccaagtagctgggactacaggcacctgccaccacaccaggctaattttgtttttgtatttttagtagagacggggtttcaccatgttacttttaaatgtctataaatatgcctttaaaattcatagtagtcttggacagtatacaaagtttgacttagtgggggtataaatttaaaaaatacgaaaacaagggaaacaaccaccatgtccaacatgaaaggagtaccttagttaatatgatccaccaatacagtggaataccacgaggtcatgaaaatattagtgaaagatatgaatatttgtgatataaaattaaataaaatgtgaaagacaaaattatgtgtaaactacaattgcaactacttttacaaggcacccatgaggattaagacacagaagatacaatgcaaaaaaaaattactttgttaaattggtggaatactggaatttcttcttttattcccaaatgtttttacattgactttctttttttagagtaatatttgtgtagaaacttaaaatcaagcgcaaagcacctatacagaatcacagaattttggagttgagagaaaccttagaggtcagacacccttcctatcttacagttgaggaccctgaggccttatgagggttcctgggcggggaatgcagggtggggggtggcagggttacacagctaattaatgatgctgctcttcttcactgtagctgcaagactaaaaagtgtgaaaggcccaaaggtactaagaagctactctgtttggacctggaagcttcatcctctaaaaatccgactgcttggaatgttttgcagctctgcattccagtctgaacaggcttcttggatgatgcgattttaggtaattatatcttcagaaataggtttctgaaattttcatagcaaactgaagtaaaatgtttcacatggcaaatgacacagagaatcagtatgaatcactgaaggatggatgggttattgctccaaagaaatctaaaaaaccgttgatcctacaactccagactccacaggtggggccagcctcttccacacaaggtctggacataaggtgacctgctaagtccgcatttccaaaaatatgggcgggaagtagatactgtccgatatgaaatcataacaaaatgagcactatcctatgaaatacttgttttccctccccctcttctccaactgtttgaaattaagcatcacaaagtccgtatcagccatagtaatctttggaggatgggggagagtggtgagaaagttgaattccaagagggaaaaaaaaaaagaaactacactgaattcctcctgttccctttggagggtgaagaggaggaggaaaagttggggaaaagataggaaaacaccagaaatagtaataaaagaagctgctgttaaaatttatgaatataaatgaaaaaaatcaattaaagatctaaaatcacatactaatcaacggtgctgaaagatctgaaagaacagagaagcaagaacaaaatgaacgcgcataaatacatttaagttgctgctgccatgaaaggcctctactgagtcccacaattacttcaaagtctccaaggaaggtgagagaggcgagtgctctcagacataaagggggctgcctttttgaacaggatgacaatgcaatgctaagtcacaacagatcacagaagggaaaaacaactgcacacacttgaagaccaaaagcagccgtgtcttctgagcatcgtcctgttgaagggagatgagactcacagacagggccaggaaaagtgaagcaaaatccaagaggcatctaaggataacatgaggtctgtgaatcagagactgctgtctcctgcagggtgctgcagaaataaacctggcaggaagtgtgacatatgctacagggaggctgagccaggctggaggggaaaattgggcagggagaggagtcaggctcctgtcactgccccagctcaataggcagggtggaggagctgtttagtcaggaaggcacattttacctacagagacctactttttccggagggagcactttggataaaagcaaattatttgaactaaccacactctttcttccagtgccctttagatttaagaattgggccctcagagtttacattataaataccatacacgtgaaagctgtctcctcaagcacttagagctactccatccacggtggaaacatacactttggaatcaaagcatggagagttactggcacaagataggattaaaatttacagtccaagcatcccatcttagcagcacacattaaggcaatctattagaaaagcaggatacatcatgttccttctttttcagtcgctgtgggaacagcagctggctttcaacagccctggcccctggattagctgctgcgtgggctgtttctatataggctggtctaggagagggcctgaaggagtgactaagagcaaatgctagacaactttcccatctttcatccttaaaacattcaaccctaattagaatttaaaaagtcatatggatctatctttatcccaaagacagaggctcagactgaataatttaagaaaattctcagggaagtctcaacataataagcaaagaggttcttgttcaaaaataataaaacctaaaaagagaaaaaaaagccaaatagagccaaaaagaggaatctatgcttttaagcatttgaatttggaaaacaattgcaaatctcttagaaacttaaattagctattatcaaccgatttgctcaggggttctctagtctaccaactcacagaagctacaaaaaaaatttacttttattttctaaatgtcaccagttttcaaccacagcaaacagaagggtatcctgtcttttaacttacactcctgggaatggggttgagagaagaagaataaaacacaagtgatcaatcaaatacctaggttaatcaatagaaattttctgaaacatatttagtaagactgacattaaaaaatgtctagaatactatcataaagcctctaaaggaaatctaaggagcaacttgtcacagtggaaaaacaactatttgaaaaagcaaataagtacccttcatcagagtaacttatactcattacagatatgggttaaatggctttcagacctttaccttatttaatatgggatagtaatcgcatgtctttactctgaatgataaccacctccacagcatttcataccctatctatacataaaccactgtcctcattcccatgttctttacagtacatatgtaattaattcacttccccatctggaggtgcctcaactctgaaagtgaggccatgggccaggttctctgtcacaaacatacccagcttcactacaacacacattgtcttttctcatgaaagcctgcagactgggtgccctttagggaaaaacaagcaaggcaattatcatcttctactcacatgtcaggcagaccagcactgtgcgcacaaacaggtccaccactaactcacagtgctcgggcgctcgggacacaaagaaggggatgatgatctcagccgggacgtagaactggagtgcgtaggtgaaaaagatcccgatggagtacagcagcttaactgactggtacaacctgccgaaacagacaggagacattccaagcctgctcagcacacttatacatcatcagcaagagtgcaaaatggtcccattgcgatttgttgacacttatcaaggatacaaacccacatgtccttcggacccagcaatttcatgtctagaaatttatctcacagatatcctcacacacatacacaaaagcttatattcaaaatatctcactgcagcattatttaagaaggaaagactgaaaacaatttaaatgttaaccagtgggaactcgataggtaaatcgtggtgcccccgtatagcttttaacaaagtatgaggcagaactctaggtgtgatggtgtgatatgaaactatccccatgatatatcactctatcacatgatatagcatatcactatcatggggacagttttatatcactttttttaagtgaaaaaagcatgaagcaatacagtacctacagagtgctacaatttgtcttaaaaaagaaaaaagaggaggaaaaaacacaccctcaccccacatgacaatcatacactaaacatctcaaaacaaacaaacaaacaaaaaagaaactgggaatatggttgcctctgaaatgggaaattgtaaaattgggaactagagtggagggcgcggggtggaagcttaatgctctctatataccttttgaaaatctcaatctttgccatgggcatacaggtgtacatgccttcaaaaataaaaacaaaattgcaattaaaatgtcacaagcccatttatatctgtcccatccaagtcagtgtccctagaattagatgaagacactgcaggaccaagaggccagagcagaattccatctttccataccactatggctctcttcctactactgcttcaagtgtagcttccaaaaatgacgtaactcaccacaggatatccctattttattactccagtgccttgactgcacagagtaggaaaacagtctgtgatcaacttacagatctgacctggtcattaaaaggaaaggtctctgtccctaagcaaagctccacgcttaaaccagaccctcatgtgttaaacagcaagaaacatttgtcctcccttgtcggaaatctatttaaatgtgctaatacagactgtgtatatgtgccttgagtttctctgtggttgaatttaaaatctagaagatgttcttatgctataagcaggagaacaaccttgtaaagactgagtctggtaaaaggtcatacttgctccatgaatagataataaaaactcttgggaaaaatcatctggtggctctatcattaaactcaaagcagccccaaagcctctggagagctgtgaagtctggacttaggagagtgacacctgcagggatagccaaataaattatacccaaatggaggcagaagagttacagcagctgggtttggggtgttaggaaagaagacagattctcctctatggcttcggatcatgtgggctgcttctgttgctcccgatccatttatcttccagggaaaggtgacacagttacaccaagctaccacctgcctcttccttcttggaagggcagaaacatttggaaatttaaaagtagacacaagatggatatgccaattaccctgatttgataattacacattgtacatatgtatccaaatgtcacacatactgcatccatatatataattggtatgcctcacgagttaaaatcaactgaaaaagaatataaaaaaataaaaagcgaatccaggtctatagccataccattctgaatgtgctcaatttcacctgatcttggaagctaagcagggtcaagcctggttcgtccttgaacgggaaagcccctggaaatactgagtgctgttgtcttaaaaaatacaataaaataaaacaatacaaaacaaaataaaaagcacacccaggcagatcagccagcctagactgaaagctgattctgatccgcagagcactcaacaagcttctcagtgtctgctaacagctgctctccaccatgagatgattcatcttcaaaacaggatggttgctctgcacatgccctgggacattcaccctttcaggaagcatttcaaaatggctcactatttccctataatacattcaccaatgcaagagaggtacaaaaggactcccaacaatccccggctcacagtgagatgctcccatctgcatatcaagcctgttactaccaagggagaggcacaaccgatgctgggaatcaaatgcaggtttgccctcccatctccctgtctatttggaatggtttaccatgaatggactagatactcggtccttctgagcttaggaattccaaggagaaatggcttacccatcggctgatcagcaccaatggcttcagcagaaggctctacatgaattccccaaacagaatgcagtccagggcagccagtgagggctggcagtggcaggggatggtgggctagagtgaagtgggctggtttaagagataagtaagagggagaatccacactgtgacccattagtttttaaaaatatccagtgctcctaggtttccatcctccctccacgtaccagcagttgggcaggttgagggttatgctgccttggatattagctccaaattgcaggtaccccagacaccccaggctgatgtagaggatggtgacgatgaccatgcccaggtacaggatgagtgggaacttccgaggatccttcattttgttttccaggggcagaacctatgagagagtagtgagagaggagagaaagtgcagaaaaaagcaaagttaatggccaagaaaaaaaaaaacctcagaaaaaaagtaactcttttatccccagaattctccagaagcacatctgctctttaaataaagttatttcatcagacgttatgctcttgggactagaagggactctgcagcccactgcctagctaggaagtcctaaaagtaagggtggacaggacacgagcccaggactcctggctcaggccagtgctctgtcctcctgctgcaggatccctgcaggctgggaatgtcccttgccctgtgagtgaggccacatggcaaccagaaggccctctcatgtcatgcccacctggcatctaacctgagatcacagcttcctgctaacctgtctaaagaatgcaaaatataggtcagggaaaactgccactctagctcaacaggggcaagcactagcagtgacaagttaaacctccaagtgagagaaactgcagtgcgaaagaaagcatgacttcgtagaggatctcaagacatgggtgcttaacaatgcccagtttccagactcctattacaaaccactgacctttgctacctccttcatcataagagaggacattctttaactttggtaaaagcaaaggaaaggcccctatgaaaatgagtttatttaggaattgggaaaatggcaggtgtgactgtgaggatcttcacagtctgccatcaactggatctggcacagctaataaggaagagcaacactgggcaatgtctagctgtgccacaaactttgatcttgttattacacttattttcctgcagcacctgcagccatgaggcacaataggtctgtgctgcacacaccaacatgatcctgctgcaggcctggtgctcccaggggcccccagtgtcccccaccacctgctccagcttcagttaatccacatccattagaaacagcttctaaatgtatctgtcagtttccatcataccaagaatacaaagagccagagggcagggagcccatatctggcctgtgacagctgcatgaacacagagcacacggtgaatacagtgtgcagcctggcactttaccccgatgcaatgaacaagccctagatccaaaactaagagtcaatctagcagtgttctctctctattgtaaaaaaatagaaatacaaagaaatcttgaaaacaaatgatgtttgcagaataactttgtgtacaagtcttgggtaataaaaccaagcaaacaatttctgcactgtgctgttagggaaagctactaaaaatttagcacaaggtcccttaggatgcccaagaacctaaggtctctgggcatctttccacactttctcagcctcttctttccagtcctgagttcttgggatctctttctcactgctgaagtatgggcccactcaggcctctgccccagcagcaggaaaccatttgtgtttctgaattacagtgagacactcttcatgggcaatgaaaagccctaagatagagcacagggcaaggtataaaacctcagggagaccagtgatttacatgtgatcactcccaaagcctcccccatgatgtcagagcttcaacgtgttccatcaacaccacctgggtgatttctcacgattttgacaaaaaatgtgtacagcttctaggttttcttaaaagcaaataaggtgtctcggaaatcaaaaaagagaaagaagtgccgtgccgggaggaggctcttcccatttgtggcgcccttggccaggaataactttcttcagagaagagttttgtaccattattatgaaaaatacaaataaaattcaaattaggtaaaagtgaggggtagattcctttttaggaaaagcatttggtgaaatcacagaatgctgagccaggagtgaaggctgctcttttgcacgcagaaaatacaccaaaccaatgttgtagggcagagaaattattcatgcatttattgattcaataataaaataacattattaataaaataaaaatctattaaacatttaccatgtgtcagggtctgtgcaaagcattttgcacatatctcatttaatcctaataactacgaatcattaagctcacttttcaggaacaaataatgaaggctcaaagagatgaagcccttgctcaaggtcacacagctactctatggcagagccaggacttacccccatgtcagtctgactctagaccctgccttcctgattgccatatgctattccttactgcaaacataggagatgagtgtgcagtgaaggggccttgaatgtaaacattttaaaattacatataatttgtcttgaaaagttgaagctgggaaatctcaatggaatccccgaaacactattcactaactgaccagtgagttacagaagataatttcttttttttttttttttttttttttgagacagagtctcgctctgtcacccaggctggagtgcagtggcgtgatcttggctcactgcaacctccgtctccccagttcaagcaattctcctgcctcagcctctcgagtggctgggattataggcgtgtgccaccatgcctagctgatttttgtatatttagtagagatggggtttcaccatgttggccaggctggtttcgaactcctgacctcaagtgatccaccagtctaggcctcccaaagtgctgagattacaggcgtgagccaccatgcctggcctcagaagatactttctaacaatgtttgctcagcattccttgaaacagacctggagaacaccaagggcaccagagaacactagcccaaatcacagtgcagctcttaccattccaatgccttcaaatgaaaaaatcgctgtgccaaagaagagagggtaggtcttccaaggggccaccaaggggaggtggctggggtctgggatcctctgaaagacagaaagcaaaacaaagcaaaaggctatacagaaattcaagatttgaactctgaatcggagaggtcataccttttaacaaatccaagattctctaaaggaagaaagtctaatacctgacagatgatttagggacatttaacctttgtatgtttttctcttcaggctaagaaaaacccacttgtttgggggaaagacaagcccaaggtactattaaaaactcaaatgttggggcttgcataaaaagagtcacattctttcactaggtaatcccatccccagaaactgaattcaagtagaaaaaaaatcaaaagatgaaaaacactgagcaaagctgtttaataaagtaactgaaaacaatataagtgcttccaaacaagggatcagttaagtaattaacaacataccagctaaaccacagaatatatattctttctatctatctatctatctatctatctatctatctatctatctctatctagagacagagtctccttctgtcacccaggctggcgtgcagtggcgagatctcggctcactgcaacctccctctgcctcctgggttcaagcaattcttcgtgcctcagcctcctgagtggctaggactacaggtgcgtgccaccacactcggctattttttgtatatttttggtagagacagggcttcaccatgttggccaagctgtttgtgaactcttgatttcaagtgatctgcctgcctcggcctcccaaggtgctgggatcacaggcgttggccactgcgcctggccagtatgcactattaaaaagtaaaaattgagataactaagtagaacatgaaaaactacttacgaaatattagtgagaaaaaattttaattttaatttatatattcactctgatacaactacataaacatcaaagataaagctggaagggaagagaaagtggtacatttttatattggttctcttcctttttcctcttcttttcttctcctttttaaaattctcatcaatgaacttgagcactttcaaagtattaccaagaagcacacaacaggagtgctggaacatgtggggaggaggagcaaaaagaatgctttaaaaaatgggccagaaaaagggcaactgttaactgcaggtacaatgttaaggttgtataaggaaggaggttgtgatggttaatactgagtgtcaacttgattgcactgaaggaggcaaagtctttagattgttcctgcgtgtgtttgtgagggtgttgccacatttgagtcagtggactgggaaaggcagacccacccttaatctggatgggcacaatctaatcagctgccagctcggccagtggccagattaaaaagcaggcagaagaatgtgaaaaggctagactggcttagcctcccaggctacatctttctcccgtgctggatacttcctgcccttgaacatcagacctcgagttcttcagctttgggacttggactggcttccttgctcctcagcctgcagacggcctgttgtggaaacctgtgattgcgtgagttaatattccttaataaactcccctatatatgtacatctatcctattagttctgtccctctagagaaccctgactaagacagaggtatagtcacaaaatcctccaccgaacaacagtctccagtaacagactgtgtggaaggggcagggtggggaggagggattcaaagctgctgtctttttacaatttggttttctaaaccacatgtgtatgttgcttcaattaaaataaaaattgatgttaaaacagccttttacaatgttttaaaattgatttaactgtatggctatttggataatacggggcatgctcttaacaggcttcagaataatttcaggcaagtaaaaggagatccattattaagctctataacagccttcactttgaaagatttcaaagcagtaatattgcttttgaaaaaataaaaaaattaaataaatgtgtttccctgggcccctgctaagaaatctgttagatccctttgtaagaagcatttcaatacctggaatgaagacagggtaataggtatttttcctttacaatgggacttgagagcaagagtggcctgtaattattcctgagtcacaaatgtaacctaagttattggaaacaggtgctatctgttggttagtgaatgactcctgctcttattcatacatcagatcagattcaagtatcagactgggaatttcacaatccatatgtggggatattgtgggaatgaggccagcagaagaagtgtattattctacatacttactgattgctactgacccaaccaactaaatgagaaaagtttaatttataaagaaacatacatgttaaaatcagctcgttattaacatatctcctcaattctacaacacagtaagtcctcccttgtcgtcaataagttcttggaaactgagactttaagtgaaatgacgtacagtcacttccttcaacgctgttttgttataacattgatgagaaaaaaactgatttcgctatacatacatttaatgtattgcagtttctaagaatgtatcaatgatattaagtgaggtcttaccatattatcaattataataacagtattttgagaaaatgctgttaaaggtacacatggattgtgagatgtactcttgcaatcctgaaactgttataactatgaaaaaatacatctcagaagcaacgatatgcagtgataaaacatttattgggagcaccctctgtgcaaagcactctgcccagaactgttccatttgagactccacatgctgaagacagagaggaacctgctctctgtggaagaccttggtctgctacctacaatggcacgtgcatgaggggcaagaggaacagtcatgtacatgcttaggattagggaaaaaattcagaaacattgaacagtaggggaatcctcatggtaagtggggcacaatgccaaaacagaacagtagtaacaagccgcagaggcagcggcaacaaaaatgacctaaagggagcatctttagctgtatgacacatcaaaatgaagcaactacaacactatgggcagtgactacatcaaaacacagccaaacctcttcccccatgctgtactccaggcagacggcactatttgatcacagcacaacttctggctaagcccagaggaagactcagaattgctctcaagaaatcagcagggctgcccttatgcagacattgctctgtgtcctggttgtactatgcatagacatcactctggatggatactaccagttggttgggactgagacgctataagaacccaaattcttatcccagccctctgatcatggcaaccaccacagcccgactacctgcaatgatttaaaagtaaatgcagcaggtgtgtctgtctatgggggtggcctcactcaattcatctttagtgtacagtggagtatatcctaggtgctcttgagagttctaattacaacatgaaatcatgggtaaatatttacccttccttgtttggtaatggaaatggtctatagtgcattcacaggccctccttccagtctcataaaaaggggacgtgaagaactatttattttatgtttaaaaaaatagttctgcagaagagtcaatatctgccactcatctgacttaatgtgatgaaaaaacagtcaatactcacagagcaaaatgttaatctaaattgataatgtcatttgcttagcacaagaagtcctgctttttatgagccactgtcttcctggaaactatatcagtgggtgactgggtcactgttaagcagactgtatgaaaatgagataatattcacctgtcagactgaccaaaataatactaatataattatactatatataaatactaatatatcatacatatatcaagaatactaatataaataatactaatacatccagtattagtaaggatggaaaaatgggcacttaaatactgtggaagggagtctctatgaaattaggaaatagcttttggaaaaaacaacttggtaacataacaaaaattcaaaagtgcacactcttcagcaattacacatctagacaaatatcttaagtatttatacaagtccacaaaaaggaatgtataagaacatctcactgtcttaatactgaaataatactaaaaattatccatggcctgatagccactgagtgaggacttgttaaataaatggcagcaaatctccttgctgtgatacaatgtgacaactaacaacaacaaggtagagccaggaatactaacctggaaggctcactaaggcatttttaaggtggaaaaaagcaaggtagatgaacatgtaactttaaaaaattatgtttcaaaaatgaaaacaaaatatatttcaatgtatttctcaatatacttacatgggctgtaaatccattcacaggatctagaatgagacagaccaatcacatacagcgggtccctgagaggagactcggggtggggacatggtattcaagaggtatttgtgttgtctgcattttaatgaatatgtactgatgaattatttggggaactgaatttaagtatttttttttttaagttatgcttttatttacccgcttttacttttttccttttctcaagccttagaaaatgcattctcattttcacaaacagccatagtgtttaagggcacatttttctcagcctgattttctacccatctgtatacagatgttctctctcatgccaccccacagacttgcctgcatgggttaagtgagggcaaggaacaagtgaatttataattttgacaaataaaaattaactggagttgataaggaattacttatctaaatacaggttagaaaaattattttttattttaatcttaacattttcctctattttccaactgtataccaatgattcatggaatttaacccattctaattgaaaaaaggttctaaacccaggtggccccnccctggggtggggggggcgattttgccccccaggaaggtttggcaatgtctggagacatttttggttgtcataactcatggagggatcgctactggtacctaatgagtagagaccagagatgctgctaaacaccccacaatgcacaggacagccccatagcaaagaatttatccatcccaaaatgtcaacagggccccaagaacagaacctctaatctagacataccagtagtaacatataactatttaccattccacttacatatatatattatgtatatatatacacaatatataaatattacatacatttatataatatatattattgcatgtacataatatatattacatgtatatgtaaaatatacatgtaatatatataaatataataacatataccatatatgtaaatatatatatataaaatatatatatatatatatatatatatatagtttttgtttggagacagagtcttgctctgttgcccaggtcggagtgcagtagcatgatctcagctcactgcaaccttcgcctcccaggttcaagcgattctcctgcctcagcctcccaaatagctgagattaggcccacacccccatgcctaatttttctatttttactagtagagacaggtttcaccatgacggccaggctggtctcaaactcctgatctcaggtgatccacccgcccccacctcccaaagtgctgggattacaggcatgagctaccacgcctggcttttttaaaatattgaaccaagatgataggagagggcctaggcatgtacctgaacaatgaactggtagatcatgaccaagctgaccagcatggtgatgttggccaacagggagaagatggacagggctcggaggttcctgatgaaaaccagcagcaccaggaagggcaggaaggagagcatgtagagtcgcgagtccatggtaggcgtcagaatcaccgtctcattgttgtggcagttattggtggtcccattggccgcttctatcacctagaatgaggggaaggaagaaaacggaaacacctctcaaacaacagaggccggtggatcctctgctggaagaggttcctgaggaaaggctcaggtgtgtgaacaaggccttttagaatctgtggccagtgagccatctttagagaacttcacgactatcatcagcaacccaattgtctgagctaggtttgatcatatgtacctaggacaggagggtcgacaagacatgtggcggtttctctatgcccgagctctttccatgggaatcaaatagaagacgtagatctatgtaaaatatgaaaactttaactcttttgttgacaaaagctgatttggaaaaaatcctaaacaaaaacttcaagtcatcttttgccattctcgactctggtttatgtttttttttgcttttttaaccaggtgcctacctgtttaaagttgtcagccagaaacacaaaatagacacagcagaatcccagctgggtgacaatcaggaagaagtccacaacacgtctggaggtggggaaggaaggaatacaaagactgttacaatacaaatgcaatgctcccagaaggggaggtgttttttgtttttgttttttaatagatttagggagtacaagtgctgttttgttaaatggatatactgcatagtggtagtgcctgggcgtttagtgtacccatcacccaaacagtgtacattgtgcccattaagtgtttttttaacagtgcttttccccaagccatcacagacccttcctggcagtgacaaggacgagatgccctggcaggagaagaaaccatgctaggtgccactggtctggggcattgggaagaaggtgagggaggtgctatctgtgtggtttccgacgtccccttcctggcttctcgtctggaatgctgcatgaggtgagacacatgcacagacaccatgaccactgcccagccccttagcatcctctctacacatctgcccacctatcccatctcacacttttttgttagttacagggagcccttgacataaaacacaaggaaatagtccccttcactgtctctataacttggatataagaaccaaccaagtcccacattaaggacacagaaactgatgtaccaaaaacagactgctggttgaacaatagcagctggtaacaacctaaaggatcatcaaaagcagagtgattaaattatagaccgttcttaaatggaacattacacagcagttaaaaagaatgtgttaaatctctatgtgctgatagagaaaaacgtctcagacgtttaaggggaaaaagcaagtttccaaacagtatacatagtatggtcaatctgtgcaaaaaactttaagaacatgtgtatgtttctacttatacagcaaattccaaaaggctacccatgcaactgtgaccaaaattttctttcactttttactttatgtcctatcttgatcaaaacaaagtttttactatgagcacgcattaaaatagcacacattttattaaaaggaaggaaggaaaggagggaaggagggcggaagaaaggaagtagtaagaaagaatggaaggaagaattaacaaccacccaactcatggtggtcacctggcaatctagcttctcccagttacagaaaataatttggccaaaagaactatataatctgcatcacaggataaaggtgactatgaatgaaagtaagtttcctctatgacaacaaaaaggaacttttctagagaacatagttttaatgtggttctttttttttttttaagaatttttagcccttgatagtatcaatttcctacatttaaatgtagaaaacaaacataatatttccctccaaacactgaagagttaccataacgagaaatttgcaaatacttcccacctccaaactcatctccacaccctgctctagtttatctcaccttctcctgaagccttctttgctcctatctctcatgtgcgtttctcatctggcacagccgacaagagaatctttaaagttcctctctctctgagcactgagggtgtactcctagctcatgacactttcttcttatgggtgtctcccactactggtctcttatcttgttccccggcttctcttcccacatttctttttccttacacagactacaagcctctggagggtaggaaccacataatttacttcaggaaatcttcccttcttacctagaactgttttgttccatttataagatagtgcttaaatacatttgttgaacaaatgagtgaatcaaaaacaatcactggtcatagaccgccaaagctggaatggctctagagaccattcaggccaggccccatgctttcctgataagaaaactaaaacccaaggaaaaaaggggttacccagccccaggtcacacagcttactaccagcagagctgagccacagccccaggcaactgacccaaacagcactctttccacgcttttacactgtctcccacgttgcacctccccatctgaaggcctcacactgggaggccacagttgaaaggaaggaggaaatcagttaccttccccagtgtgcgtggttccggagccaggagcaggggctggattctagtccatacatcacagtatcaccataatccacaaaggatttattcagcctggaagagtaggagggaagaggaaggacagagcacgtggattagacaatgacaatgacagaacaaaaagagccactgagacctgggccagttcccatctttcaccctggaggtaccactctgagtcctgtatctcgtgctttcaaagatcagaagtattcagtcgacaggatggttacttttattataattaacaaccatctggtagaatcatttcaatggggtaaatattacaacgcccatgaaattagaatgtagtacccactgggcataagtaaatttaacagatgataatgagccagaaaagaacgcaaaaataaccagggaaaggaaaacgctgcaatcataagctgctacctccagccagtgtaaagaattgagagtggtctgcatcagtgctcattttcagggttgataacagaacccaaaaggacaatctgtcacttgagaggtggctcagagggctctcacctgcggcagaagtggtgagcacatttcaccaggatacccatgcagtgcacggccacgatgcctatgatcagcaggctgatgggacccatctggggacagatattgcaggcaaaagagagagagaaaagtaggtagaattaggagtgaacccaatggatactcagttcacaaaggattaaaaagctactaaggcagttttcagtgacaaaactttgggcccagcattagagagagaaacgtgatcatggagattagctctgtgagatgggtgttatctgaactttagcacattttcgagagatttagtcacgtggagaagaaggacataagataagtctgttccaagactggtgcacatcagcagaatagaaggctcctgtgactgtgggaagagctgggctaagggatgtgaggtgagacgggtaagttatctttacagcaatgccagatcaagaaagactgcacttagctaagggcaacccacatctctgagtctctcttcaactccgaaagaaaccagaatggctttgggcaggcagtcaactggaggtaaatcacaaaaagaagacataagattcttgcagttggccatttaggaacagggcatgggagactgtagaaaatgggcagacatctgtaactaactcattagttcatattattgacagaaactgctcgagccatctcagtacatcctctccaccatgaagtaagctccatgagggcaggaatatttaattcactgatgtattctaagagcttagaacagtgcctaacgcacagaacactctcaataaatatctttaagtgaatgaatgtctgaattccgctttttgtcaactgatttttttaaaatgcttctctatttaaaatgttttaaagcaagtacattttaacaacaacaaaaagctacctcctaaaatttgtcaccactcctctccactgatgcagacccttaccacgatgcctgcatttttcaccgccagagggagtcccaggagtcctgtgccaatgttgccttttaacaggtggatcaaggtctggaaccatctgaagtggaagacagccaaggaaatgataaccatgacagttaacttttattaggatctcagtgcttatatgcattatcttattttatttccacaacaaccctgtaagattttatcttatagatgatgaagcagtttgctcaaggtcacatacctagtaaagggctggggcaggattcaaatttgggcagtctgactccagagctccccctcttatccactgtgctgtaagtctccactctctgacatttctgagaatcccttctctcagagattagaccagaggggtgctccaactctcttcagacactctatcctttccaagtgtatttgggtctggttctaaccactgaactgaccactgtaaaggctcagacctggccaggcacagtggctcatgcctataatcccactactttgggaggccgaagcggtggatcacctgaggtcaggagttcgagaccagcctgtgccaacaaggcgaaaccccgtctctactaaaaatacagaaattagccaggcatagcggcatgtgcctgtaatcccagcttctcaggaggttaaggtaggagaattgcttgaacccgggagccagaggttgcagtgagttaagatcgtgccactgtactccagcctaggcaatagagggagactccatctcaaaaaaaaaaaaagactcagatcccaaaactgcaacagaggatgacaaaccaaacaatgacggacaaacactggtaagagaacagaggaaattaaaaaataataataataataacagaagccccaaaccctgtaacagaaagatacaaagtgaacagcataaaagtcacaccacaccataagaggccagaagtccctgatacatttagtatttaaaaaaaaaaaaaagtcaggccaggtgcagtggctcatgcctgtaatcccagcactttgggaggccaaggcgggcagatcatgaggtcaagagattgagactatcctggccaacatggtgaaaccccgtctctactaaaaatataaaaattagctgggcgtggtggcaggcacctgtaatcccagctactcgggaggctgaggcagaagaatcgcttgaatccgggaggcagaggttgcagtgagccaagattgtgccactgcactccagcctgggtgacagagcaagactgtctcaaaaaaaaaagaaaaaaaaaatccattggtgatcttgctctttcaatggatcttttacccatgcagaattcctaacatcatactttggttgagtttacacagatcttccaatgttaacatcttcattgtatattaataatatcaaaagtcatatttgttaatatcaccctaatctcatcagaaaagtcttcaagtagaggggctatcaagctcatggtactggatacagttggttttttttcctaattttgcttgaaagcttgaattttattctgggcacagatatgtattatctattgttttccttgaggtgatgggctgatttctttcattttcaagaaaatgtcttacaagtactcaggtctgaatgacctacagtttgttagttgttctttctagttctatgaaaaaaaaaaaaggcagcaagtttggttgacaactcatataatcactcgaggtctttgccttaagacaagtaacatattttggtactcatagaagtacttcatgcatacttcccattttgccacacagaatattaaagacctatactgaagggtctcaaatttttaaatattagtaatcctacagtttcatcaaagacattattaagtgcaaagggcttttttctttgcgcatgtgtggcagtgaaaaatacaacgacaactagtataatttggtgccactgccttgattcgttctacagtgtaattttacccaccattgcttctacattataagtgcaaatatccacaagtgaaaaagcagataacatcttagtattattatgaagagagttttagcctcatagacttcttgaaatggtcttgggaagcccacaaagtgtgcagaccacattttgcaaatgactactccagctcacctttagagagccagtttcagtctgctggtttcagtttgcatggggaagaagcacggaggcttgatatatataatggaactcagaggggcaacaagaagaaaaatctgcccaacagcataaaatgaggctgtcttcgaagcagtcaatagcttggtaacatcaagtgttagtaaataacctcactgaacacactaagaaataattcacaggtcaggcatggtgctcatgcctataatccaagcactttgggaggccgaggcaggcggatcacttgagcccaggtgtttaagactaagtgggcaacatagcaaaaccctatctctacaaaaaaaaaaaaaaaaatacaataagtagccaggagcatgcctgtagtctcagctacttaggaaactaaggtgggaggatcacttgagcccaggagatggaggtgcagtgagccatgattgtgccagtgcactccagcctggacaacagagcaagaccctgtctcaaaaaaataaaaggaagtaacccatgaaactcatggaagtgtttggggttcctatttgcaccccctaactaggggtttttgctgagcccttgacttctagaagagccaggtgtgtgcatgcatatgtgcagtaggtgtagaagtacttccatgtattttgttccttggcaaactagataaaagggtggggcaaaccagaaatataaaaggaacccagctcaaaaacttgtctctaacacttccgacatattaaaatattaatttaggttaagaaggtcctccaaatcaacctctaccttaatcatacctggcatgttttctatataaatccttgcgtggatcctatgccccaggctggaagtactcaaccagtcctctaagattctgtttctgtagcttatttctcaggggatatgcttttgtagattccccattagcctgcagtgggagttagctggtggtagattgcttagagcagcagctggcagcagtgtggatcaccctgcccctctttcctccaaccttatcagcattggcagcccccatgcagaagcatctccacacacagccaatggcatgtgatggcttcccttcagaggtcatgcttgttatcgtaagatacttctaagcttccttctctgtagtttcctttgcagtttttgctcctttttgatctcagatatcaacttgtctaagcaatatttagcagatgaggtctggatttttatgtttatagagacatctctgaagctcaaaacctaccaactagcaggaagcttagaagtatcttacgataacaagcatgacctctgaagggaagccatcacatgccattggctgtgtgtggagatgcttctgcatgggggctgccaatgctgataaggttggaggaaagaggggcagggtgatccacactgctgccagctgtgctctaagcaatctaccaccagctaactcccactgcaggctaatggggaatctacaaaagcatacccctgagaaataagctacagaaacagaatcttagaggactggttgagtacttccagcctgaggcatagaaatcagctagtggtggtgacgggccaggaatgtggacagacattcttctagttccaccccagttcgcaagagaaaatgccctgtaccagcagacagtgcaggcagagggagcttctccagtgatgagcccagaagctttcatggtcccgcttgggccagtcatcaggaatggcataagtctaggacatgaagatctctcagtaagtcacactcagtccacaagaaaacacagaaaagtaatagctaagcttgaggaataacaggactggaaaagctgagatgctggacacaaaaaaaagcagagtctgctgaatcagagtactgggaactactcatggagtacaacttctctgaattttaattagtgggagcccacagccgatacttgggtgagctcattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctttgagccgctctaaagagtacaatgctagtcattatcatagataaactatgataatgctgtaaatacattatcctagtttatccttcttatgagataggtactatcaagtcacccatcctacaaaaaatataactgaggctcaaagaggtgaagtaacttgcccaaggtcatacagcagcagataaggcctgagcagaatctgaatacctatctgtgtctatagcctgtgtttttctttgctggcctatggtgcctcccagtgcatggaagtggaagtacgggaccaatgcaattgatggtgatgatgccagtcattactaagctcctgtctaggcaggacgtgtgcctgggtctgagaatacagaggtcaggaagccattctctctcatctctccctaggcaatcacatccatgctcttggctttgagggccatctaccaatcctctgagctgccaactccaattcccagctacccactggacacctctgcttggatgtctcacaaacaactgggaaataatgtgcaaaacagagcttcggtttagcccataaacctgtcctgccttcccgtctgggcctttccagtctcataaatgcactaccaccgaagtcttcatgggagccaacaatttagaaatcacccctgaatcgtctctgttctttctaactgcacatccactccaccaactcctatcaatttacatacaaaatatgtccgaaatctctccgcttcctgcatcttctccatcactccgtggtctcagccccactatctccagcttggatgacttctcactggtctccctcacccactctatagagcttgaaaaatgagcttcctgagacacaaagaggatcccttttccgtctgaaaccctccaaccacctctcattgtacttagattagaatctaaaagtgttaccaaggcttatacttagaagattggatgccctggtttgtcaaggacagtcttgatttttacctgttgtaaatcagctactaccaagtattatttttagtgcctgttttggactctatgtttgtgtcccctcaaaattcatatgttaaaatctaatccccagtgtaacagtatttggaggtggagcccttgtgaatgggattagggcccttatgagaagggccatgtgatacaatgagaagccgacagtctgccattcagaagagggcactcaccagaacctggccatgctggcaccccgatctgggacttccagcctccagaactgtgggaaatacatttctgtcctttaagccacccagcctatggtgttctgttgtagcagcccaaatggactaagtcagtgcttctctcactctcaaagatcacagtttggacctcagataatacagtcatccaagccacaaggcccacatgatctacccagcctatctcctcagcctcattcccacccctgctcatgatgttctcagtacctcagccatacctcaagccacttcaggctctttcccaactcatgttgctcttcctgcctggaagactctcctgcccacttttcacatggttggcagcttggctctctgctcagatgtcacctcctgggggcagcctccctctgaatgtgtgtccccctgtcttatgagtctctcatcactttacttccttatcatcatttgtaaagatgttatttctttctttatctgtttattgtttatctccatgattacaatggaaagcccctggagacaggaatcattccctccttaccctctgctatgttcctagcagcttgcaaatggcctcgcatgtagtagatgctcaataaatacttgtcgagagatggactgactgactgaaagaatgaatacatcattcccagcccataagtttacagaatagtagggtccactggacttgagatttaggaaagagatttggagaaataaagtgagggagagatatcagaccaccatcttggccactgttctttagcaattcctatgaaacccataacaccaccaccagaatcccctacacacatgtgcatacaatatctcacttgagccccaagccagttctctgaggtaggttgttttagctcctgaggttcagagagctgttctggctaagctctaggagctacagccagagggtgttttgcccaggcacagagcagggattaagaatttggagtctggggtcagagtgcttgggtttgaagcaacccacctttgccacttattaccagtattactttaagccagtcacttaaatcccctgtgttcctcagtttcctcatctgtaaagcggggtggtaactatacctgccctgagtgttatgaggctttagtcctgagaaggacctagcccagtgcctgatgcatcctaagtgctttgtacattttttccctaatgacagaagcactggtggggcttttgccagcatctttactgtccccatggtcaccaccagaagcctagcacagctctcacctggatctgaagctgatctttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattagaagggatcatcagtgaaggacagctcaggagggaaaatagttagatttccacctgatctgcttctcttctgattgcattccctctaggtcactaaccaaagcctttcattgaaacaggcaccaggaatgcctatgtgattttagaggcatcctacaaagagcacagatctagaagacaaaggtctggttttcatcctggctctgctactgacctagtgtttgaccgagaatgattctgtctgcctgagccaggagggatggactggactcggtaagtacatagcacacatgtactgctcccctctccttcactccctgcaggcatcactaatcaatcaatggtgcctacccagcctgggcacagtttcagactccttcccttctcagtgctgaggagctagcaaagatccaaggatcatccagcaaggttcagctcacgtatatcttcctccctgaacccagaccctcctcagccacagtgctagacatgcacgtggctccaaggcctaacatggctccacaaatcaccacaaatggattcaccaccattacttacctccaggatgtgttcatccttgttctctctgtccagctgctgggctgtagataggagacctgagagagagatgataagggagagacatgagcagaagactttcagggccactttactgaggcaacttcaagaattacattcaaatctcagataagaattcttctgatctttgaagaacatgtaaagaccatccctgacttaggatagttcaacttaaatttcctactttatcatggtgtggaagtgatacacattcagtacaaaccatacttcaagtacccatacattctgttttttactttcacttcagtattcaaatactgaagtattgagtacaaatactgaagtgttgaaatattcaatactttattttaaaataggctttatgtgagatgattttgccccctgtaggctaatgcaagtgttctgagcgcatacgaggtaggcaaggctaaggtatcatgttctgtaggttcggtgtttaaacacagtttagacttacagcattttcaacttatgatggatctattggaatatgacctcactgtaggctgaggagcatcagaacactaaggggaaatgaaactcgggggaaagcaagggggaagtgaggagctgggagagaacagcagagataatgtgtcaggtgaagttcccagctacttcctgctttctctattaggcaggggtgatacatcaaaacttcagcaatcggcccaccacgagcagcctcccgtcaggatggttgccagctggaagcaaccagtagggttactggtgcacaagggtcaatgtcagcactgctgtgatgcagttttggttcctcgtcactaaaatctatggaacatgtttgcatctggatgtcttctgctcatcattcattccctcttctttcaataaacaaaccccagttctcctgaggggaaaccaggagaattaggttctaattaggaattagaaccattcctagctttagtccttcattatctggggtgaggctgacccgcctggggagaagtttatagcccaaggatagccagtcagcacagactatccccctggcccttgcaactggctctgcaatagacaagggacccgtctgtctgatgagaatccattctgggacttttgcaagagctctagaaagagacttttttctgctgctgtgctgagagaacagaaggaagcctgacagcaacaagaagagggactcctgaggctagacccactcagagaaaatgaggccaagagataagcagaggcagcgccttcattacattattccaacactggctacagctgtgcctgcagccatactatgtttggaattttctgtaaagtaagaaaacaaatgtcttttattgcctcagccaacctgcattgggtttctatctttacatctgaaaaagtcctgacaaccaattcaattctgagaattcatatgttgggataggaatgggttacgggtcatggtgaggctgggaaagcattcagggtctttgggattgggaggcctccaggaaggacgctacctcctgcctcagcctctcccttcccctcctatggccctgccaacccccagctccagcctcaggttccttacaggggacccactaatcccctctgtgcctcgccttgactccaggaagctcctgcttatttctcccaaccttatttcaaccccagcctcctctgcaaaaggagttgaattcggtgacctttaacatctttctggcttaagttctgaacttctcatgccactttaaggaatgtattctaaggaaatcagtgcatacatctgggaagatgagttcacacggtgttcacctgagtcacgttttaaaaagccaataattggacacaatccatataagggaagagttgtatacattttacataaaaaggaatcttaagcaactattcaaaatacattctgtaaatggggaaatgctgcacacaatatattgttgaagtaaaaaagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttattggaatccctggcctgtgctctaaagagaaggcttacctgccaagaccccctagtccttgtgctcttcctgggggaccccaggccctaggcccttccccatgaggcccctcagcttggggccaagctgggacagtatccagaccctcctgtcctacaggagtgtgtctttccttccacttgtcctccttctttgactggaagggcgcctgagtgtggagcttctcaggagccttctccaatcccttgcacgccaaacttcagttagggaagaaaaagccggaatgacttgcgttcaactgcacaaggcgagaacacgcccccgacagagcccacatcctcacaccacactcccattgccatgactggaggctctggcccagaactgaatccctgttcccctcgctgagctcccagctctgtcactgagccccccagggaaactctgggctcttcactgagcttctttttctacacttaattccattatctcaatcacttcatcacctaaacaagatcaagaaagtgaaagtgttcagatgttccattaacctcgaccagtagctctgctttcatttacaagagaccgtccacaccagccacggcctcttaggccatggctttggatgaccttctgggcccctgaaaacctccacctcaacttccctgaatcttgcagagagctagcgccttctctacccaacttcttcaattacggatgaactgagaggagcccagaggagccccctctctatttatctgcaccagcctgtcatgggaagagccagtactaggaccctagtgaataataataataataaatggggaaaatgctgtcacttcatggtttctctgaaacggaaggcaatagttgttatttctgctgtagctcctgacaagctgcttttttttttttaaaggagtctcgctctgttgcccaggctggagtgcagtggtgagatcttggctcactgcaacctctgcctcctgggttcaagcaattctcctgtctcctagtagctgggactacaggcacacgccacaacatccagctaattttttttgtatttttagtagagatgaagtttcaccatattggtcaggctggtctcgaactccttacctcaggtgatccgcccgcttcggcctcccaaagtgctggcattacaggtgtgagccaccgtgcccaggcgacaagctgccttctttagaggacagtagcaatggttctcatggacaataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagtaaaataaagaaaaattatcatctgagttcaaagtgaatgccatgaaaaatagataatgccattttcagagagcatcttagatcggttctcaaaagtgtgcctaaggacagagtttcctgagctgcatttcgaaggctggggagtactgagggagcaagaggacaggtctactatctctccatagttatttctacttctttttgttgtgtacagagctgtgaaaatgataatggccatagtacaatagcagagagaatcaagttcgtgttgataaacttttggctgttgcatgtatcattccctgcagcccctgcacccctcacacccagacttcctacttaacagtcctctaccctgtacctaaatgtggcacaccctgccttttggtctcagtttaggcatcagtttagctgggaagccttttctgatgcaccaacactggttggttaagtaccatctccttatgttttccgttgtacctaagccatcccctgaccttattacttattattcagtattgtattgcttcagacttggtgtctctgtcattaaatggaaagccgctagaagcctgtgctctttattttcctttgaattccagtctagcaccatgtctgatacatgacaggtacttaaaaaatatcacttgaatgaacttcagtacccagcccgtgaatgtaacctggggttactggggtattggaagttataaccgtaagggttccaatgtgagtctattgtcttgagaagatccagttctctactagttttcacttacggactggagcttggattatatgtaatccaagtagtacccagcagtttaaacttccaacttattatgagagcttattagagcaagctgtctgtgcctgtctgagactctcattaagccattccatgaaatatctgcatgaatctgggcatcttgcatctgagagcccatttccggcggttagtgcagttagaactgaaaccagaggctgaaaatgagtcggcacttgctcactagcatttaggtcactttcaatttaatctgaaataaaattctgttcctttacttcttttttaaaaattaggatactcaagctattttcatgttaactatatattttctaagttgttagtgggaatagccaaccagtcactttctcttgtggagtgaaagaaactcttgccctgtgagattagagtgaggtgttaaggaaaagatgtcagatagtttgaattcagaccttctccgagctgtctctccaaatgtggtacttgaattcaggataactggtcaaattctgcactaaacataaggaatgaattctgcctccagtctagacaaagtcagtgtacccttgtagttatcagggatgagagctggcttatatgctgtagactgtgtaactcactgggatacatttaaaaatggatgcattgaagtggttaaatatgacaaatgaagaaaggaaaggaagtcacggtaatgtctgaattcaacccaggtttctgtgtcctacttgttcttatacctatttgtctgtaaacatgtggatttttttcctgaatagaccatgttgatgtatggtattcacattgtgaggtccatgtattagtggcattttaggaaaatatagcccgaagtggggaagctatcacttgaaaacatgtcatcatgcttggacatagccaggaaattaaccatgtcagcatgataatatttcttgaaaagcctgaaacccatttttctatgctgatagttatcagtttctgctataaactcacttgtattatgataagatatcttcaaagtttttttttttcttttttttttgttctaatcctaagaaaacagagctggtgtctgcctgactgccccactgggagataagttgttgaatgaggtgtagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcaaccccagagagggtggaggagggagaaataagggtttggtggggaggaggctgtaggaaggaatggagagaaagagaagacccccactttgaatcacccgagttgcattcttttttcctttgttctttgtagctgtgacttgaagctccaccaatatccctatgtccccacgagccccaggaaagctggccccagcctgcagacctcattgattttgttgtccagcttcatcacttcccctggtttcattagtttcttttgaaaggcactccggacccgctgccagtcttccccttccctgtgagagaagcaggaatacatttagagcacactgaaaagaaaagaaggagatgcagaaatactccagctgcaacttcaggaaccataaaatcaaacaaacaccgagaatcatgccaagaaatagccagagaatattagcatcagaatatttgggataaaatagtgatcatcttttgacaatagtttgacaataggatgaaaaagcacctttcctcctagtcaaagattgcaccaaaaagttgaagtccagataatttgggttcagggattttgaggtgtccttgcagggagtggggctgggaggcctggggacaattcctagcggtaaaagggggcatgtgaacaccccatcaccagcaactcagatctgtttgagggaagaatcttgtcttctttcaactcattggtgtgggcttcatatttacaaaatatctcagatttagaattttgccatcgcctccaaataataacatacagtcagagagtcactggagtaataaaaagccttttgcgatcgtgcacttgtaggcacctgccccatagcagaccatacagcctgtgaagcaccgtgaatttaataggtttttaattccagtcattatatactggaaaatataacgattacgcattacagtttgggggtaaataaaagtgctaacttgttaaatgcttacaactaaaaagcagaagaatcacattccatagtagcatttatcgacctaaaacacaactttgatattccttcttattcaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctgatcgcttcactgactgtctcgtccattggccctcaaaccccatctatctgccttggcctcccaatgtgctgggattacaggcttgagccaccgcacccaacctttttttctcttatagtctttccctcagagagttcctctgttcacatctcacatctcatcatgctggatattcccaaatctatattcccaaatacttccaggcccatattttaaactgattttataaacacaacatggcaaacccacactaaccccttccctttcaaatcaaatctctttcttttatttttccatatgcgcaatgtcatctggattacttcacacagcaagttctaaatcctcgtcttctctgcctccttcacttcctcagtcaatgtattatcaagatctgttgattcttatttcacaacatctcacaaacttgacttttcctcccatcccaaatctatcatccctccaagaagttcaactaccaatggtctcttcctttactaaatttgacctgtacccattgatgtagccaatgattcatgactttaataagtatttattatatattttattgatgaaatgccttatgggaggtgctgtaaatattataaagagcactaataggaagtccttctgcttaaattctgtataatgtagttaataccacaaatatatagaactttattatatacatatattctctctgcagcttaaagtttcataataatatataactccattgactaatcaggtaattatgttttaattaccctgcttgtaacactaccaatggaggtagggataagcccttaccaaaaataatactgagtgagaaaccagcatgtccccagaataataccactgctgtgcttgagaggctttgggctttatgcatcctaacagtggggaacaaaggtgattagaatgtgtgctctgtggtttgctaatcatggtgctgaagatcaagagtttgatataattgtacttaggggtttagggccaatgacgaaacgtcgtgaagtctaaaagcatacctctctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaaagagccccgacaacacgataattttagcctggaagagcctcatcagacttctgacctatagaactgtaagataatagatgtgtgtcgtgtaactcactaagttttagtaatttgcggtggcagcaatagaaagctaggacatcagctcactcattagtttacaaattgcctgtggctgctttcatgttccaaggtagtattaagaggatgtgacaaagactgtatggtccataaaacctaaaatatttgccaactggccctttacggaaaaagtttgccaacccttactattcacatgcaaaaaccatgaacagctgctagcatttactgaacacttaattgatgccaggctcaggaataactacttggtattcatattaaatttttgtgatacactctctttgggtcatcattttacaaatgaaaaaaaaaaaggaagtagagagtttagggaactgctcaaggtcacccagcaagttagaggtgagctgggattcaaaccccagtctggctgacttcccagcatagctcatccctcgtcattctcactaccttgcagaggataatgaaccgcctagatgctcacctgaagcgtattatcgctggcaaaacgcgatggggagttcccggctgggcaccagggtgcctgagtgtagcatctcaacaggctcattgtctgtggcctggatgtcgtatttgcggacaatctgtaatgcacacgcacacaaaaacagaattacccctctcttcttctgccttgtgaaacagcacagaacataattgcagaaaccggtaaaggttttacccaacaaagagccaaatgcagttgaagctctgctaatcggcgaccaatgcacattctttttccaacgccaaatggaagatgcgcaaaaggattaattttttccttctcctgaagccaacgttcaagtcttaactgacttgaatcttcaaaattggcttcactggatccaacacctgggtatttagcatgagcactgtctaaacacatgcgaagacccatagtatttaaaataaccagaagaaacctttggaatggcaaattgacgcgaggtgtccacttacaaatcaaaagactaattcacaaatttattatgatgattggtggccaccatgcgctagtgcttaaaatggtgccaggcattaatatgttaagggctttaaattgtgccccatactcacagacagcctgtgccagagaatcttgtattaaacccctttacagaccgaactgagctctcagagagtatgggactgatctaggacacccaggtctaggatggaatggagccgtgtcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaggtgcactcgagatctagagattcagatggccacaaactatctgtcatttaatttagaaacaggggtgaaagaattaagaaaaaaaaagggtagcctcaaaattgggggttggaagaacctaagaccccttttaaatacgtaccgggggttgggaaaaaatttaaccaaacagttaaggaaccctttaaatgtggagggatttatattggcagataaacaataagccaagattaaagaaactatgaccttcaataaattttcaagacccagaaaatgaccataaacaagtagcctttgaaggtagtacagccccaaaaagtaaatgtggttttctaactttatctcagtttggtttttggtagaaatgcaagagcctatcagagggcacagccagaaacgaccaagaacaactgacaagggcattattttcaataacagaatcagagtcttatcaaaagctatatgccactgccagcccagggtgtctctacccttccaagtaagcaatttttatcagtgctatgtgccaatgacatctatatgtatctcattacacttttttttaatgagagtttaaattatgattatcctgttcatattcctctactgtataaaaatcatgggggaggggtgaggagttgataagtctccataaagagctacttttagaaaccttgaactttctggtggttgcaatgactggataagactttacttggtctcctttgaggggcagggtatatcccacatgtggacaaaagggtgtgcacagttttttattggtcacggggcctaattgtctacaaaactcatactacaaaactataatatagaacatttctgggaattggaagtctaataagggaatctatttctctgtcctttttgcatatggtgttactatatgcctaattctcagcaacaatgaacaaaaatgttgtattccacttttaagccacctttaaagaatcacaatattttattcttctcaccactttgatgcaaatgaacagggcaaatttgagccatgtattgaaaatggaatagccagaaatgaaaggagactgggtatcttcatcactgtctgaaggcaacggcctgtggattatggacaatcatggtgatgttatgcaattgagaaacagacttttttcctctacaaattattacacaaagggggtattttgttgtttcagctcgggatcacccctatgtaaaacattctgtaataaaaagcaccagtgcaaaatttacctgcatttaggtatggaaataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattctccttcctttcccgtgggttttccggggttcctttcaagaatcagactttcaacccctttatatgtaggcccggtgatccatgggggaaggtgataaaacgatgaagggtgtaaatgatgaacatgcccaacctgtcatcgcttaatgggttcccattcttgccccatatacaggaagcccaaagggattaagcttgttcttaacatttaccaagcactggctacattcagggtgtttatatacaatctttccccgagacatcctgtaagctggttatgattattggcccattgaatagatcgggaaacctaagttttggaaatttcaaggagcttgactaagatgatgccaagcttttagataggatattaaagcccaggcccacctatcagagtgcaagctttcagacacgaggcttgggtgcttctcagagtatttcatgcttaacagcacagactcacataaatagacttccacaatatagtatagatacatggaggctaaggccatgaactgaaatttagtgtttccccaggttgaagtaagtcaattgtgttgtagaaaaaaaaaaaaaagatcatccctacttatttaaatccccaaacaccatctttaaaacttgagcctatgaagaaaaagaataaagacttttgaaatctcttatgctatccatgatggcatttttgtaaatccattcctgtttcactaaacaaaagtagaaaaaaatcatgaaaacccccaacacagtccatctggggcgtctcagtaagaatcgtgctcacccactccacagcatctttgaggatgtggccttaagtcagacgctgctcatctgttcctgataaatctcttgtaggctccaggactcttcctggcatcaaaaaatatggaacgcatgcaacgacactgtcctcttatttattttagcaaatgaaaatctgccctcacaggtttatggtcaagatgtctaaaagatgtcttggatttgtatttaaagagcaccttaacagtaagtgactcctaaatgagctcttccacataataagatagaatagtgatcatgaaacttaaagtatcctatttgagagagaggatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgggcagtcatcaggaatggcataagtctaggacatgaaggatctctcagtaagtcacactcagtccacaagaaaacacagaaaaggtaatagctaagcttgaggaataaacaggactgcaaaagctgagatgctgggacacagagaaaagtcagaggtctgctgaaatcaggagtagctgggaaactaactcaatggagtagcaaaacttcctctgaattttctaattcaagtggtgagccccacacagccagcatagctttgtggtggagtcctcaatttttctttacatttggggaaagtgagacctgaagcgggccaaactcagcccaaatgagtctggggtcccagtttctggagacaagagattaagccctctttggagaatgcaaagtctatctttcctttcctaccaaccctgaattttttaagtgcagaagttaattcttctctcttcccacttcttcagtcaaatgaatactgatttggtgatggggcagaattcggggggagactttgcaaaggaagcttccgattatgcttggaaattatttggggttctagcacagatgacacacttttaaattaaaagaatgtcctctgtagaagctttttttaagtccaagctctcacttggcaccagccttggggggccaacacagctgaaaggaaaaaagagtaagaaactgcctagagagtggcagcccaggaaggcaaatctcagcgcagtcactcgcccaatctcttcactgctgaccttcatctgtaaagtggaggactgatgaaattggggggaaaaataagtccaagggaggcttaggaacacgaatcccacccaggagaggagaaggtaacagctactcacgttgtgctattgctttgaccaaagcgctggtaggagcccggggaggagaggttgttgaggccttccgacgggctctcctcagggctcacgtccgtggagctgtagtcgtggtagtcttcattccgaagtctctgcgtggacatggcagctggggggacagggccagcattaagacctcctgcagctggagcctttagctccatatttggggtggcctctggggtagaagctgtcattgtcagagttgctcactgtgacagctccactatggattaagtatgaaagtgcctggtaccaagggaaatggaaaagtgcaaagtacacagaggcgggctgagttcacttgacttctgactcccatccttcccattggtatacgtggtgctacactcataaatttcttaattttccggagtacagctagacaaggcagaagtgaggcaactgctctgcggaggatgggggaaaatgaaagagcaagtgcttcctggaattccgcattgccctattccttaggtcaggattatctactcctttctgagataatgtcttggaaccttgtgcaatagcttcaatcgtgctgctgtatatatatatatataaatcatcccatatatatatatatatatatacgtatatacacggtgtatgttactatattatacacgtatacaatatacacacgtatatctatatatgtacaagctcttggggggatggaaatctgggtatttctcatcgtatactctttttcctctgccttcaatagagaacacatttcactcaagaaatcctctctgggctgggtgtggtggctcacgcctgcaaccccagcactttgggaggccaaggcgggcggatcacctgaggtccggagttcaagaccagcctgagtaacatggagaaaccccgtctctactaaaaatacaaaattagccgggcgtggtggtgcatgcctgtaatcccagctactcgggaggctgaggcaggagaatcgcttgaaaccgggaggcggaggttgtggtgagccgagatcgtgccattgcactccagcctgggcgacaagagcgaaactccatctcaaaaaaaaaaacaaacaaacaacaaaaaaaaagaaaacagaaatcccctctggatcatccaattctgctgaaactcccaccaaatcccagagccacacatgccgttctctttctctctgctgtgaccacaggctgatcctatactctctggaggccaccagtaactcttataccctgaccctggggactcctttcttgctgccaacctgagtactgagaaatggtagctgaaagcagctcagaggaggaccaggaaactgaaaggtgctcaccctggccctcgtctcaacatctccatccacaactcttcttcctttttatttttatagatgtgctcatttttaaaatggtgagagaaaaaaatgtcctttcaatgtgttgggagggtggtgagagtggtgtcccctgggtggatttactcaggaatactattaatactacacaaaagagaagagcaagggcttcttaaagatacacaataaggacacattttgggagcgatgtaggcccctagaatcctagagaccattgctaaatgagccttcacaggtcactctaagccccttactttaaagatgaagaatcaatgctaaaagatgaagtaacctgccctgcaacagctaggtagtaccaagcagaaaacgttatctcctgacccctgtcagaatctgaaaacaaccactctacagagtcccagttgctatgagagagtattacagcacagtgaaagagtcaacttcctgctcttcaagaaccaagtgacaaaaaaagggtacattaatataaaaaatgacaaaaatcctcccgacacttggcagactggcacagctacttgcccgtcagactgtcctccggcatgtggctggatgcccaccttaagcctgggcactctatctcagctaccttgagaggagacaggacctccaactgctgccacagcaccccaccctgccccgacacccagcaccacctgccagaggatggtgctccgccgaaggctctccttaggtccagtgccagggtactcctttggaaacaccccagtctggcaccagagagatccacgggagatcgcattttctctcaacaattgcaatgtaggaaaggacccccaagctatctcacaagggaagtacctggcaaaatgccagcaaaggacctggaaatcccagagacgatcctgcctagcttcattgccagagccacttggctaaaaatctatgagagcttcatttactcatgagctagaggaattcaaggacgccaaccagctctggggcaattaaactcactagagggccgggagaaaaaaaaaatctctgaagtatcttaataccagcattgtaacctcttgctatacaggtataagctcgtaaatcagtttacaggtatgtcaggaggcccaggcgccaagcctacctctgtcaacagtttgcttagtacctgtgaaccattttcaaatgtgcaaaaagcatggggcataaactaaaatatctctcaactccctctagcactaatattctaggtgtcaatgaacataattatttatgcaaacagcagctgagtgcagtgtctcacacctgtaatcccagcatttggggaggctgaggtgggaggatcacttgggcccaggagttcaagaccagcctgggcaccatagtgagaccctgcctctactgaaaaaaagaaaaagctgccaatttctagtcccttccaacaaaccaaaagcatctgaagatagaaccttccaagtgaatcttgtgagaaagaaaagaaactttttatctgaggaatccctttaaattacgggtccagagaggcactaaaatgtgagagcagtcatgtgtcactccccccttgagttaaataattacctcttgaagccacttgctatgtgggttctagactaactgacaccactaagtcataaaatgctaacactggacatcataactcataccctatagtccaacaatgtacagcccatcaataatccatgctatttctgtaaactgatgagaattcctgtcaagtcactttgtatcagtcctctccttgttcgcttttgcctttaagaatctgtggtaacaaaggccgaaggacgcactcccccaggcaacttggaagtgtgtcccgggcagctgtcctcacttggttcaagtaaacagttcaagtaaactgttaaaaattgcattttgtgtctcaacttcttcctttaggttgacacctatatattactgaaggtgaaaggatggaatacagggacttattaattgcccaatccttccctagcaaccgagaaacctctctgttgtctacttggtacagatgttcaatttatctcaaacactgcagagagacttctttatgttgtgtataaaaactgaagttacccacagcagaatattgctaagaaaacttctcaacaagaagctgaaatctatagatttaaggtccaataagcctgcgggatatggaagatgtggctaagcaactgcatgcatattgaaaacagaaaaaaaaaattctgcttgggagttctggttgatgataagctcaacagaaggcaataatataatccaagatgccaaataaaccaacacaattctaggttgcattaggacatgagagaatcatgggtagacatcggctccatccatcccacatgctagtaagtggacctcggctccatccactctacaggccagtaagtggacatctgctccatccactctacatgctagatgttacacatgggtacatgttacacaactcagaattgccagataatgtgttctcttccaggcagcatgctataaaggggataatgacaaattgtggtatatccaggggtcagaactaggatcaagaggggtaggaaaccaactaaatgaggaatggttgaaagcactgagaaggttccacctagcaacttgaggggtacaaaaactgtctttaaaagccgtctctactaaaaatacaaaaaattagccgggcgtggtagcgggcgcctgtagtcccagctactcgggaggctgaggcaggagaatggtgtgaacccgggaggcggagcttgcagtgagccgagatcgcgccactgcactccagctctgggcgacagagcgagactccgtctcaaaaaaaaaaaaaaaaaaaagctgtcacatggattagacttgttatttggggcctcaaaggtcaggcagggctaggatcagtacgtggagagtcaagagggctgattttttgctaggtgtaaggaagaactttctatcaaagacagatctgttccaaatagaacagatcactctgggagaaagcctgttcccttatccctgaaaaaatccaagcaaaagccctttctcagagcagttatgtaaggattcaagcatcagacagtgggcagagccactccccggagttctttctatggctctttttggaaaccaaggcctcctcctcctgctctctgtctgtccccatgagtgctggcatccatggccacactgcccttaggctccctttgatgaaatctgatagccaagtctattgctgcaattgccagttcccgccctatgggagattttaatagtacctgttaactgtctaaatgagggttgtactatgtgagagttgaaggcaagcttgtccttcagattactgaggacaataaacagaacacaaagtccaaatctccattagatatttagactcagaagagtgagcaactgagtaaaaaaagtctgcaagtttgatggccaaaaaaaaaaaaaaaaaaaaaaaatttaagtgtacaaaccttaaaacattccttttttttccttatgtaactattgttttagctgtataaatagacaagtgttgctcttcaatctacaaaatatgccatttttagatgggcactaaaaatgagcaggtggaatcactttgtgcaacggatgcaatatggaaaatgtatgtgcaaactgaatttttatttttaaaaataaaataaattttattctatttttaaaaataaaaatttgtaggtgttaaatttttcagaagtgggcaattttaaggggaattctacagtgattttttttttttaaggcaaggccagaaatttttctaataaattcaaatgctaatgttcccattttaacagcatgggattcaggactcaggagaacataatctggctgtcattctaatcccaaagttgttttcttattttgatatagaattgagaaaactgcattagatgatttctaagtacactttcacttctaaagtttcaggattccaatttcaattttttagtgactgggtttgttcaaaataaaggaggattaagatcaatagatggtaacatattctgaagttgtaccatccagtacagtaaccactagccataaatagctatcttacacttgaaatacacttgggtaaaattgaaatgtgcacactagatttcaatgaactggtaacaaaaaaattgtgaaatatcccatgaattaataatctttatactgattatatattgcaatgataatatctgggatatattgggttaaatgaaacatacgtcaaggaaaaaaaaatagatttctgggcccaacttgattccaccttagcattttattttattttattttatttatttattttaatttatttattggagatggagtttcattcttgttgcccaggctggagtgcagtggtgcgatcttggctcgctgcaacctccgcctcccaggttcaagcaattctcctgtcttagcctcccgagtagctgggattacggacatgcgccaccacaactggctaatttttttctatttttagtagagacggggtttcatcatgttggccaggctggtgtcaaactcttgacctcaggtggtccacccaccttggcctcccaaagtgctgggattacaggcatgagtcaccatgcccagcctatgtttttttgttgttgtttttgtctttttgtcttctttttttttttttgagatggtgtctccctctgttgcccaggctggagtgcaatggtgtgatcttggctcactgcaacctccgcctcctgggttcaagcgattctcctgcctcagcctcccgagtggctgggattacaggcgtccatcaccatgcccagataattttttgtgtttttagtagagatggagtttctccgtgttggccaggctggtctcaaactcttgacctcaagggatccacctgtctcagcctctcaaagtgatgggattacaggcaagaggcgttttatttttaactagcttcctaggtaatcttgattataggtagatttatataaagcactacaaaaaatatatgatcttattatgataggtacaccctaggcctcacctcctaccagaattcacgcattggcgccccttgtttgcaagctaaaagtgtcatccgttattctgaaacaattacattggtttggactttggaactcagagcagcggcaaattccccagatgtattttctcctctctgtcgatggaattctaaaaacatgaacaaagacacagactgtgttgctatgtgtggtctacagtgagggaagtaaaatggtttggcttctacataatttgtttttaaaacagcatcagatagaattccatccaacttaccagagcagaacattccataaattgagactttttcctgtaggagtctgatgctagaacagctacagggcagctgctgacctcagcaggttctgcacaaagcagctgctgaacaggcaaacacgcacacttttactcccaaccatgaagatcactaaatgttagggccaggtatagctttagagaaggtcaagctccagcttccttcttaggggtcagaaaaccagggcccacacacaaaggctgactcatccaggccccaggatgagtcaaatcaaagatttgagatgacagtccagcaaaccagcatcccagtccagtattctttctaccacaccttaaattatataccctccttaaaatctccctgcgaacaaagctggccccagagcctggggcaggattaggtctgcagcgggtattctgcataataaaaagcacctgagtttgcagtctggtagtgtgactctgagcaagttaattcatctccctttgccacagtctcctcatctgaaagatgtcattaataacatctacatcacaatattgttatgaagataggaggaaaaaataaataaatgttagatatgttgcctggaacataataaaccctcattaatgatagcaattgtgattattactacagagaagttcaaggacagaaagtgagaaagttcactaaacaaagtctgcagtatgggctccatttaaaactctggattgtgaagccaggtccctaccttggagatggtgatctaagtgacatgaacatctcagtaacccacagacagatttcctaacttcatggaaaaggaaagcacagagtggcttttcctactagagatggtcattaaggactagccctggggccaagcatggtggctcacatctgtaatcccggcactttgggaggccaaggtgggaggactgcttgagctcaggagttcaagaccagcgtggacaaaatagtgagacctcatctccaaaaaaataataataataaaataaaataaataataagtaaaaaaagaactggccctgggtgtcaaggcttccaagagaaatattttgggggataaaagaagagacaaccccaaatgcagcaccgtgtggttcctatttcagcctatttacaatgccccatccatcggcccccatgcccattaagtagaggctacctttatgtgctcatcacagtaaggcctggccaaaggagagaggtacaggattcttccaaggcctgggtggaagtaaacagactcagtgagagcttcttctatgggaaacaagagaaggcctggatggaaataaacggattccatgtgagttcctctatgggaaaaagagaaaagctggcctaggtgtgagtaatgctaatcagtcatgcactttggaagcggttatcagcaccaggccaggaaaagcagaaacagaagactattcactcatctgacctttgaagcgatatcaagcatttaaagaactgagatactcactggaggggaggtggtggtgataaaaagaaagaaaaagcaggagtacttaatatgagaatagttacctgagacaaggttataaatagaaacaagagtaatcacaaaactggacatcagctccatccactctacatgccagtaagtggacatctgctccatccatcccacatgctagtaagtggacatcggctccatccatcccacatgctagttaagtggacaccagttccgtccatcccacatgctagtaagtggacatctgctccatccactctacatgctagtaagtggacatctgctccatccactctacatgctagtaagtggacacctgccccatccatcccacatgctagtaagtggacaccggctccgtccatcccacatgctagtaagtggacaccggctccgtccatcccacatgctagtaagtggacatcagctccatccatccgcacatgctagtaagtggacatcagctccatccatcccacatgctagtaagtggacatctgctccgtccactctacgtggctagtaagcggacatctgctccatccactttacatgctagtaagtggacatcggctccatccatcccacatgctaataagtggacatctgctccatccactctacatgccagtaagtggacatcggctccattcatcccacatgctagtaagcagacatctgctccatccactctacatgccactaagtggacacctgctccatccatcccacatgctagtaataagtggacatctgctccatccatcccacatgctagtaagtggacatctgctccatccactctacatgctagtaagtccagtcctagaatgtcacagactcttgagttgaaagaaaacttaaaattttgtctagtccaaccctctacccaacaatctaatttcatctacaacatccccgaagtaattgcccagagacgattacctccagtgacagggagctccgtgctcagtgttctaatacaggagaccactaattctttgaaagtttttaacacttaccaaacacccttcccttatggcactttcatctattggtcccagttgtagtctccagaatattataaaataaatggaatccctttttcttacaccgcctttggaacagagaaaactctgagcacttcgaactgccacaagaggaggctgaatgaacagctacatgccttaaagggaaaacaaggactccagagcaggcgaatataaacgatacaatcagaaaacaaagggagaggcttaaagctgttatcagcacagcctctgctgcacgtagcctccatccccagacaaacacaaagtttgtccctttccacttgacttcaagaacatttttaacgaaaacatgttctaaatgtacaagtaagttaattactgtaaacgaggctctagacaagagtcagaagagggccctgatcatgtttaaaataataacagacagttaaaaatcattttcagctgttagtatttagcttagacataatacagagataggaagaaagaggaggaggattttatagcaacagaggaataagcagaggaaactgcttcctacacaattagattaagtcttgttgcaaggctgatactcagtgtacacagcgggtaaaatctctcggaataaaaaaacaaacagaccctggtcaggggcactggctcacacccctgtaatcgcaatactttgggaggccaaggtgggaggatcacttgagcccaggagtttgagatcagcctgggcagcatagtgagacctcatctctatttaaaaacaaacaaacaaaaaaacaagcctagaaagatgcacaacatccagatcacagcagaaggggcccttaagaattcaattccatcactgtctagactgagaaacccaaacgcgagtcacttaaggttgccaggtaagcggcagagctaggacaaaatatcctgattccccaatctctgttctgtccattgcaccatgatgctatcttcagcaaaattcaaataactgcaaaacgtccatccaaataagcaatcccaaatctgacaagttacagaaaaaataaagcaaaggtctttacattcttcaagttaacgtcagggctctccacaacctcggctcagccacctatcttcccagaagcacattccgattcatatttcatattttggtgtgacttacatagaatgcaggaaggttagaaaccaaacctacagaaggatgagtttgcagaaaaataatgaacaaacagggaaccacacccagagcaaatccaaccccagcggtggaaaatgcagacagctaaaaagggagaggactaaaagagaaagggacagaaaggagtgccttttcacaggtgaagtttcccgcaggaggcggtgtggcgaaaagcaaacagctgctgaagcttaggaacatttgcattctagtcgcaggtctccgggtctccgattaactcactggatgaccttaggcaagcccttaccccttcccggagtaagggctcagtttctccaactgtcctaggagggagctgcaccagacgacttcccagcgtccttgcagttctgacccaaagacccattatgagcctgtctcaagcagcgctcccgcagcgggcaagacatttgctggaaacggggagacctgtgcgaagcgtgaaagacgccctagatggtcctttgggttatcttcaccatctaccccagtttcccccacctgtcagtcaaacaggacggtgagatcccaaccccacgaggtcaagggagatagcgcgagggacaagggatctccacgcttcgcccaattcacagaggggtgtcagcgtcgtaccgcagctgcggcccggggacgccaaggagtcgcggacccacagcccgggcggatccagtgcctgacctggagcatctgccacgccgggaggaaggcgaggtgggtcctgcccaaggcggcgagcgccgccagccggcagccagtggaggaactcactgctcgggttctggccccagctccggctccggctctggcttcagcacagcccacccttcccgggttcagtatcagcccctcgccatcctcctttgctgcccggcagccgcttccggacctcatcacgtgatcccaccgcccacgccagaggccgaggtcacgtgctcccttgagcggccgcgccttttttctcactgagctccggagctctgctccacagcaccacctggcgacctattactgccactgctggaaggactatgttcctgggcgctggggactgcgaataggaactgaacagggcattgatcttgggcatggggcagagtccagtcgaagagcactgtcccttgagttgtgggtttgtgaaatattgctaatttttacactggctgtattttcttttacacatctcgatgagtttgtattgcttttataataagaaatatgcatatttttaaaacttccaatttttcagaagcatacacaaactatcatctgtggttgctactggaaatggaactgtggggtagggcaacattatcttttaatacattcaaatttttaaagtaacatttttaaatggatggcaacatttcagtattgtattatctaggcttctccttttacctccttgttacagacttttcctttaacaattatgtaacaaataggcttcaagtcaaaaactgtcacaagagacagagaagatcattgtttaataataaaggggtcaattcatcaagaagacacaactgtaaatatatatgcatgcaaaattggagcacctaaatacatacaactaatattaatggccatgaagggagaaatagatagcaacacaatagtaggagggtcaatatcccactttcaacaatggatagagcaactagagagaaaataaggaaataatgaacttgaattgcactttaaaccaaatgaacctaacagatatatacagaactttccattcaacagaaacagaatacacattttttctctaacacacttgaaacattctctagaatagaccatatgctagtccaaaaaacaagccttaaatttaagaagattgaaatcatattaatattctttcagaccataataatatgaagctagaaatcaatgacaggaggaatcttggaaaattcacaaatatgtggaaattaaacaacacgcttttttttttctttgagacaaagttgcgctcttattgccccatctggagtgcagtggtgcaatcttggctcactgcaacctctgcctcctggattcaagcgattctcctgtctcagcctcccaagtagctgggattacaggcacgtgccaccacgcgcgactaattttgtatttttagtagagacgaggttcaccatgttggtcaggctggtctcaaactcctgacctcaggtgatctgcccacctcggcctcccaaagtgctgagattataggtgtgagccaccatacccagtcctatgcttcgaaacaaccagtgggtcaaagatgaaatcaaacgggaaatttaaaaaatattttcagacaattgacaatggaaacataacataccaaagcttatggaatgcagcaaaagtagttctaagagagaagtttatagcaataaatgcctacattaaaagagaagaaagagaccaattaaatagtttaacattatacctcaggaaactggaaaaagaagagctcacaagacccaaagttaaaagaagaaaagaaagagcagaacagaaataaatcaaatagacaacagaaaaaaaaacagacaaaatcaataaaactagagttgattttttggaaaaaattaaattgacgtaccctttgctagtctaagaaaaaaaagaagactaataaaataaaaaatgaaagtgaagacactacaacagaagcttcagaaataaaaagaatcatatggggctattgtgaacaattatttgccaacatattggataacccagatgaaatggagaaatccctagaaaaatacaacctaccaagattgaaatcaggaagaaatggaaagcctgaacagactaataacaaataaagagattgaagatgagacagggactatctgactttctggttttctgtttaaacttcccaacaagaccagatggcttcacagctgacttctaccaaacattcaaagaagaaggtttgttactaaactcttccaaaaaatggagctagagggaatacttccaaacacattttatgaggccagcatcaccttgatacctaagccagagaaagacgccacaagaaaagaaaattacaggctgatttcgctaatgcacattggtacaaaatcctcaataaaatatttgcaaacagaattcaacaacaatcaaaaaaattatgtatcatgaccaagtgggatttatccctggcatgcaaggctggtttaacatacactaatcaagcaatataatacatcatattaacaggatgaaaaatgaaaaccacatggttatctcaattggcctggcaaaagcatttgacaaagtccaacatcttttccttccctaacccccaccccaacataccttcttgataaaaaaaaactctcaatagtttaggtatagaaagaacattcctcaacataataaggtcgtttatgaaaaacacacagttaacattttaattaatagggaaaaactgaaagcttttccaccaagatccagtagcagtcaaggatacccaccctcaccacttctattcaacatagtactggaagtactagcaagagcaatcagccaaaaaagcaaaagaaagaaaggcatccaaatcagaaagaaaaaagtaaaattatctttatctgcaggtgacatcatcctatatgtagaaaaccccaaagattaaaaaaatactgttataattcatgaatttagtaaattttcaggacataaaaatcaacatacatgactgggctcagtggctcatgcctgtaatcccagcactttgggaggccagggcagtgggtcacctgaggtcaggagttcaagactagcttggccaacatggtgaaaccctgtctctactaaaaatacaaaagtcagcccagcatggtggtgcatgcctgtagtccaagctacttgagaggctgaggcaggagaattgtttgaacctgggaggcggaggttgcagtgagctgagatcgcgccccttcagcctgggtgacagagtgagactccatctcaaaaaaaaattaaaaaatcaataatatttttatacacaaataattacctacctaaaaaagaaataaagagaatgattttatttgtgatagcattaaaaaatactcaataatcaatttaaccaaggacatgaatagggtgtacactgaaaactataaaacaatgattaaataaattgaagaagacacaaataaatgaaaagatatcccatgcacatggatcagaagaattaacattgtggaaatgtccatactatccaaagcaatatacagattcaatgcaatccctatcaaaatcccaacggcattctttactgagatataagaaacaatcctaaaatttgcatgagaccacaaaagaccctgaatagtcaagacaattctgaaaaagaaaaacaaactggatgcatcacacttcccgattcaaaattatattacaaagatatagtaatccaaacagtatagtactggcacaaaaacagatatgatagaccaatggaacacaatagacagcccagaaataaattcaaacatatatggtcaactaattttaaagaagggcatcaagagaacacaatagggaaaagacagtctcctcaataaacggtgctgagaaaactggtttttatgtgagaaagaatgaaattggatgtttatcttacaccgtacataaaaatcaactcaaagtggataaaaggcctaaatgtaagatctgaaactacaaaactcctagaagagaacataggggaaatgctcctggacactggcccttggcaatgatttttttggatatcagaccaaaagctcagattacaaaagcaaaaataaataaataggactatatcaaactaagaagcttctgcacagcaaaggaagtaatcaacaaagtgtaacggcagcttatgaattggaaaacatatatgcaaaccctatgtctaataagcgcttaatatccaaaatgtatcaaaaactcatataactcagcaatagaaaaacaacccaatttaaaaatgggcaaaggacctgaataaacatttctccaaagaagaaataaaaatgctcagtgagcatatgaaaaagtgttcaacatcattaatcatcagggagatgcaaaccaaaatcattattagatatcacctcatacatgttaggttggatattatcaaaaaagtcaaaagacaacaaatattggtgaggatgtcgagaaaagggaattctagtacactgttggtgggactgtagactggtgcagccattatagaaaacagtgtaaaagtttctttttttaaaaaaaacagtataaaggtttctaaagaaattaaaaatagaactaccatatgacccatcaatcccctttctggacatatactcgaaggaaatgaaatcaccaccccataaagatatctgcatgcccatattcattgtagctttattcacaacagccaagatatagaaacaatccaagtgtctattgacagcagaatgaataaagaaactgtggtatatatacaaacatttttctaaaaaaagaaaggagtcctgccatttgccacaacatggatgaaactagaggacatcatgctaagtgaaataagccagacacagaaagaaaaaatattgcatgctctcatttatatgtggaatcttttttttcaagtcaaatacacagagatagagaatcaaacagtggtgaccagggcccaggagtgctggaggaaggaagtggagaaatgcagctgagaggatacagagtagcagatatgtaggatccataagtctagagctcaaagggacaacataaggactataggttatacattgtactgtacaaacagtagaacagaggttactagtagctgagcagggtggaaggaaaggatagggagagatttgttaaaggatacaaaattacagctagataggaatcagttctatagctctgtaggatgagcataggtaacaataatataggatgtattttcacatagctagaagaggggttttgaatgttctgaacacaaagaaataagcgtttgagatgatggatatgttaattaccctgatgtaatcgctgtacattgtatacatcactgtgtacctcataaatatgtatagttatgtcaattaaaaataactttttaaaaataaaaaaatcacactgtatttaaaattcctgtgaaatgagtaaattttagctgctcttgccacaaaaaagaaaccccaaataatgggtacgctatgtgaaatgatggagatggcaattcacttcactatagttacaattttactatctataagtatcgcataacatcatgttgtaaatgctaaatatacacaaaaacatttatttgaaaaataattttaaaacaaaaattatgttctcaaccaaaaaatactattaatacagctacaaatggatgtcaaaataattatacatggataaatcaaaaaataattatgctaagcaaaagacattaggaaaatatttcatttatataatattctagaaaatacaaaataatataaagtaatggaaaacacacatcagccattgcctgggaatgcggaggagagacaggagagagggtgattataaagcggcatgaggaaattttcaaggggacaaatttgttcaccatcttgattgtgatgatttcacaggtgaatatatatgttgaaacttatcaagttacatgctttaaatacgtgcagtttattgtatgtcaattatacttcaataaaagcattaagatattcagtaaaaaattatataataggttaatatattcttaaaagttagacaatatagaaatatataaattgaaaatcccctttccccaaattcactcccctctccaaaggtttacaggtgccagcatgtgtgtattgttctccaaaccctatattatacaattacagaaatatatacgtatgtatagaaatatacaggtttatggtgtttaaatttaaaatcataaataccagtacttattgttttgcttaagacttttactcttcacaattttctcatttctcccccttctacccacttgtctcctccactttcaatatgtgcagaactgttttttcataggtcttcttagaagctctgatgtatattaacatacattaaatacaacctcttgtttatagcacatactattaaaaactttgccttagagtatgcactccatttctttgccttttgtttcatttttttagaaatgaggtcttgctatgttgcccatattggagtgatcatagcacactacagcctcaaactcctgggctcaagtgatctcccatctcagcctcctgagtagttgggactacaggtgcatgccactgcacatcactagcatgcattctgttttaaccattgtgccagtgcttctcaaagtgtggtccctagaccagcatcacttgggaacttgcagaaatgcaaattctgggtcctactctacacctactgcatcagaaaccctgggttgtgggggcacagcaatctgcattttgaaaagccctctaggagagtctgatgctctctcgtgctgtagaaccactgccctaaaggacaagcttctgaagggacttgctttagccatgtgctaacatgttgtgtggccagcccctggtagtgacttatttctgctgagtggtagaaagtaatttgaaggtttttttccccttatttcccagctgggtgacctgggcaagacttttgatctccatttggtttcatcatcaggaaagtgagattgaaaaccctccttggttctgcctccctccctggattgctggaaaagcagatgagatcaggcgcttaaaggttctatatataacatgaggggctgctgagagatattagggaaattaatccttttgcattccatagtcttgaggaatgtaacttcctttttttttttttaaccactctacccatcccaagccctcaagagtaccagcccctgagatgtcatagcaaccctacccagtgtcccctttccctctccttctctctttttgagaccccttgggtccctgatccatcctcctgaacattctgtgactgatggccctactgtcaagcctctctctgttaagaccactgccccctacagtggcttctaactctaaaattctcaggttttgtatcttaaaaaataaaaaataaagaaaatatgcttacaatgtgccaggaactagtttcttgttgattgagtcaatcctcgtggcagccctatgaggcatttaggagatgctgtaggtgcccttcctgtatctcctttaccagagctgcagccccatccctagctgcggtgagtgttgcctgctacactgtaaagcatgctacactgttacgtagggatacaaaaggcctacctacttttgtcactatacagagagcaatgccgttattcacactcatgaaactcctgtgggtggtctgggtaattcttcgctgtagtataagcattcatcagcattatgatttcaatatttggcaacccaatcacaacaaaattcaagaatttattaagtggcacaagtgctgaaaaatgaatttgaaaattccttaactttggagtggaaattagaaaaaataaaattcctataaagaagaccaaacaccatcagatatgacatgctggtgccttaggagggtgtctcctataaagtaaattagcactggagtggaacagatgaaaaacagccactgaagcaagaaatcatcagctcaagtacataggaaaagtgctggggccagatcaatacaactggaatgtgcctcaggccatgctattgttttaaacatttctttttcttttttttttttcttttcttttttttttgagatggagtctcgctatgtcacccaggctggagtgcagtggcatgatctcagttcactgcaacctccacctcccaggttcaagtgattctcctgccttaggcttccgagtagctgggattataggcacctgcaactgagaggtgacagcgtgctggcagtcctcacagccctcgctcgctctcggctcctcctctgcctgcgctcccactttggcggcacctaaggaggccttcagcccaccgctacactgtgggagcccctttctgggctggccaaggccagagccagctccctcagcttgcagggaggtgtggagggagaggcgcgagccggaacccgggctgcgcccggcacttgcggaccagctggagttccgggtaggcgtgggcttggcgggccccagacaatgaggggcttagcacccgggccagcggctgcggagggtgtactaggtcccccagcagtgccagcccaccggcgctgcactcgatttctcacccggccttagatgccttcccgcggggcagggctcaggacctgcagcccgccatgcctgagcctcccaccccctccatgggatcctgtgctgccggagcctccccgatgagcaccgccccctgctccatggcgcccagtcccatggaccacccaagggctgaggagtgagggcgcatggcacgggactggcaggcagctccacctgcagccccggtgcgggatccaccaggtgaagccagctaggctcctgagtctggtgaggacgtggagaacatttatgtctagctcaaggattgtaaatacaccaatcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttagtagagatgggatttgaccatgttggccagatggtcttgatctcctgacatcatgatctgcccacctggcttcccaaagtgctgggattacgggagtgagccaccatgtccagcctgttttacacatttcttattgtgattttttgatgatttgaaaggaggtaattatgatataatatggtttggctttgtgtccccacccaaatctcatctcgaactgtaatccccatgtgtcaagggaggggcctgggtggcaagtgattggatcattagtggtttcccccatgctgttctagtgatactgagggagttctcagatctgatggtttaaaagtggcagtttcccctgacactctctctctctctctctcctgctgccatgtaagacgtgcctgcttccccttcaccttctgccatgactgtaagtttcctgaggcctcccagccatgtagaactgtgaatcaattcaacctcctttcttcataaatgatccagcctcgggtagtatagcagtgtaagaacaaactaatacagtgttagaacgaactaatacccaataaaacattatatcaatagtatttttgtggtaaatgaaatatgtttaaagaaaaaaaatgtggcaaaggtaatagatgcatgcactctgaggactcagaaaaaaatgttgcaagtaattcaaaattctgtcctgtgattaaacaagactgctctgccaccaatgccaggtctctggtgcctgggagagtgcatgagagatggtgaattttgcagtgacagagacctgcagagcatatgtcaaaggatgccagagaacacctctgcctgacaacctgcaggcaggatcacaatgacaggagtgtcagagcacatgtatgagacccaagtacactcctcttcttggaacaaaatgctgctcacacaggagctcaacaaaagaacaagctttaaacacattatattgctttaacataaggaagactttcccaatcatgtgcagtggccaatggtgtaccatgaatgagttatagggggtgctgagtgccaggtgggtcctaaggtagctagagcacctgagtgtgtttcgtattattggtataatcatctagcttaagaacagacctgtttacttgtgatctcaacggaaatatagaagatgttatttccttcatgttatgtgaaaaagattgggaagcactgggtaagtagggtgtcatataatttatttgttcaagtggagacacttttaagaataaaaaggctgtgttaacatttcaccagaacaacgggcacacagtgaaattgtcccaggtaaagtggaatgtatggtgtggtaggcagagtaacagctcccaaagacgttaattaatctcgggaacttgttaccttagatagcaaaagggactttgctgatgtgatgaagttaaggatctcgaggtgaaatgactatgctggattatctgggtggtcctagtataaatcacaaggttttttaataggagggaggcaggagggtcagagaggagagaagtttctattctactggctttaaagatggaggaagacgccatgagccaaggaaacgcaggaggcctctagaagctggaaaaagcaaggaaacagattctaccctacagcctccagaagaacacagccttgtcacaccttgattttaggacctctgacttctagaactataagagaatacatttgcattgttctaatctactaaattgtggtaatttgttatagcagcaacaggaaatgaatattatttataatctaaaataaatgtagctttatgtttatatcattattaaagttatgaaggtaagcaataaagaactaaaacagtaaaataattatattgagaagtaaagtacgagaatttaagaggtacaaattttcactaatataatgttgatcaattgagaaatatcattatagtatattgtatagagaaatgaagaactaaagaataaaacaaaccactggttttatacacttgatcttagccaaaagataagaagcaatcaaaccactgattaaaaaacagaaagatagtctaaaaagagcagctttagatagagtaagtcagataaggagactatagcttttcattataaattctttggttaaaataaatcatagtttaaacatgagcatttttaaagatgtgaatattaattgttaaagtaagattgtgttaggggacaacttcaagagcttattgggctcaggttctccaaagctgtagcccctttctacctaaattgtgttcatggcttccacccaactcagagcctcccctaaactcttagctcagccagcagcttccttgctgtcagtcttggcacaagatagggccaactagtagatccttctgaaacaaggcaagaaaagacaccattgaaaggaatagttccagggttgggcccaggcggatgaagagctctggagcaaacccccaaagcccatctgtagggtgggcagacctcagtgttacctcacaatgggaacaaagggcctgggagtgctcagatgagaggagaaccacccattgccactgaaaaagtgaggatgtaggagccaaaaaaaaagtctgagaccagccctgccagcttactagcaggtcccgtcagtttgggcttctgtttctcaccaatgaaatgaataggagaagttcagctctcagatcttgcaactctgagagtccttttcccagcttcagctacctttctcctaccaaacgtgactggatagtcctaggacatatataatgtatcattatatatgatactgtggctttagggtttagaatttatttgagatggtctatggcaattcattcattttactcattggaactgagcctcagagagacagaggcatttgttcaagttacactttacaaccagcttgagaatctgtgggttctcctgtgaccactcacatagaccctaagattccttggtcacaatttgcatatggttgtgtgagaacctgtgacccctcacttagacccttggagtccttgatcataatttgccataggaaggtgcagaatggtggatatggtggggtggccctcaacatccactccaaccacccttcaatctgcctttcagtactgtagaggctagaaagagtagaatacatgctgtattatctcattaatataaagttcaagagcaggcaaaactaatttatggtgacaaaaatctagacagtggttattgggtatgtgagggaggtgatgtttgactgcaaacaagcaaaaagaaactttctgggtaagttgcaccagtgtattcatttgtcaaaactcattcaactgtacacttaagatctgtgcattttattgtatataaactacactttaaaaatttcaagtaactaccttagagggatgttcatatatgaataggcaattcatatattgcctattacatagtaggtgctcaataaacagtagtagcaggggcactagtaataattattgatattaatattaatatattggctttcttttggtaaaatttgcctgctaaatctttcctatcccttttactttaaactttctgcattcttatgttttagatatgtctttcataaatattattttgatattttcaaaattattctatttattgtattaataattacagatatatttatagtcatatttaccttgttattttattctatatcttccacctattatgttttttctcctttactgagtttcttttagattaattttcccttattttattttgttttattctctagtaatttggaacttaaagactttatttctattctctagccataccctagtaattttaacatgtataaattaataaagtattaacaaaaagttaagcaatatctttagtcactgcagaaaatataggcacttaaaaaaatctctattcactgcattccattttttataataataatgtcacatattttaagtttcttttccttatgctccataatactttattattagaatcaagatttacccatacatttacctctcttgggttctttatttccttttgcatctcagatcttcttctgaatatggactttaaattttcctttagtgaagttctctccaatttcttttgtttgaaaatgtcttcattttgcacttaacagatagtttatatcctctcagcatattgaggtgatcattccagtaccttgtggcttccactgctgttaagaaaacagctgacagactgactgcaaatcttttcttttccttttgaaatttcttttacactgcaacccttttgaatgtaacacttttcaccaatctggctgactttagatccctttaaagttctgaagtttcactataaagtgtccagatacgtgtgtcctttatttatcctgcttggaattcactgggtctcttgaatctgtgggttggtgtctttcatcatttctggacaattctcagccattatcttttcaaatatttattctaccatattccctcttaacttttcttctgcgagtctgatttgatgttgccttagtcagtttgggctgctataacatattaccataggctgggtgacttaaacaacaaacatttatttctcacagttccggagaccgaaaagtccaagatcaagttgccagccgatcctgtgtctggtgagagctcacttcctggcttccatgtggctgtcttctcattgtatcctcacatggcaaagagcagagaggacacaaactctctcatgtctcttatttcagagcactaattctgggctctacctcatgacctaattacctcccagagatcccccttcttaataccatcacactgagggttaggatttcaatacacagtccatgacagatgtaggatatatttaggtctttcattctattctctattttccctcacttttcttttagatttttcatcccttggtctctgtggactatattatgaataatacctttcccagatctagttctgattcactaattctgtcttcactgtgcataatctcctatcaagcccatccatttcaactaaaattaactcaactaaatttttaaaattcaattaatattcagttttaaatttcaactattataattctattttctagaagttttatttaattaactttccatttcacctgattactcttcagagtatctttctccttgtacatatcttccagtacatttttttctgttactaaatatgttaaaaagagctacttttcgtttgtatcatacatttctcttttgcaaagttcttgtgctatatttaaattttctcttgttttgctgtttcttggaattttacttacataaattctttaagatctgaaatgaaggtgagtccctcctgaaagactttgtatttgcttctgccagcagctggcaactatcagtctaggttcttgtgaactacattctgggctggaggtattctggaccaccatggtagatgaagtagactgtggaacagagtgaaacttgaattctcattccacattttagccacaattttactccatcctctgggcactaggttcaggacagtcactttttttccaagtcccttgattgggaggtagggaaggaatagggtgggggtgggatattgatttatttccagttcactcttactctgaggaagaggtcctcagctccggaatttgtctcatgccccataaggccatgatattaaagctcaacttcactgggttgagcaaatacccgtgggagtgaagctgtagctgcattccactcaggtctcagagttcctgtcttcacctggctgagtgagtactcacctagaaattccttgctctcttgatctcccctcaatattattaagaatttttttaaaatatgttattcaggccgggcgtggtggctcaggcctgtaatcccagcactttggaaggccaaggcgggcggatcacctgaggtcaggagtttgagaccagcctggacaacatggtgaaaccctgtctctactaaaaacacacacaaaaaaaaacagctggatgtggtggtgggtgcctgtaatcctagctacttgggaggctgaggcaggagaatctcttgaaccagggaagcagaggttgcggtgagccaatggcctgccattgcattccagcctggcaacaagagtgaaactccgtctcaaaaaaaaaaaaaagaaaaaaaaaaaaaaaaaaaatatatatattatagtagtatattatagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcattgcggaaggtaaaagcagtttcacatggtggcagagaagaaggtttgtgcagggagactccctgtttttaaaactatccaatctcatgagacttattcactatcacgtgaatagcacaggaaagacccacccccatgattcaattacctatcaccgggtccctcctacaacacatgggaattgtgggagttataattcaagatgagatttgggtgggggcacaaccaaaccatatcaccatggctgctccacacccctcacatgcccaatacgtggagctaaacagtgaggtatccacctgcctgggcctgtgggtgcctccaccagctgccagtccctggatgatgcagcccaaagaataccctgccagccccgagggagggttcagcaactcctccacccggagctcctgctgccaggacagggccagcaggacctcgtaagtgtcctttgctccacagaagcttctgggcttgagaccttgcacctgaaaacttttgtggaatttttcttctttctagtaatccaaagagctaaatctgtgctctcctgtagttcttgacagacaagcaaagaggtgtagagaagttgtgttagtagcaaaaataatgctccatgaagtgatgctttgaatcctaagcataactccttagaggcgcattcattcaacattcaacacctgggaactgtggaactaaagcaatgaacacaacataccatttgggtccctgcagctaaggatctcacagcctagggaggaagatatgtacacacagaagtgaaattccagggagtgaactcagtgttctacaaggattcagaaaaggaaggtgttatttccagatggtgaaaatgggcaaggctttgtgttagaggagccaagactgatctagtccttggagaaatgatgttgccagtgaggatacccaaaaagcattatctacctccactgaagaagatagatcaagctttatccagcagaatagtaacaatggtattgatttcagacaataagcatcaactgaaataatccatgcaacaaacaacacagtacctggcacacagtaactgttcagtaaagggttagctaattctacggacaggcacggtggctcatgcctgtaatcccagcactttgggaggccaaggcaggtggatcatgaggtcaggagttcaagaccagcctgaccaacatggtgaaaccccatctctactaaaaataccaaataaatttagccaggcatggtggcgggcacctgtaatctccagctactcaggaggctgtaggcagagaattgcttgaacccaggaggcggacgg

SEQ ID NO: 12 - DNA, 1539 bp, Homo sapiens
cggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaaatggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagttccctggccatcctcatcccccatctgggcatggtccttacccagatgagcttggtgagcagcagcaccctgcccctcatcatcctgtgcctcctggagatgactacctactactcagagtgcatgagctccctcatcatcaccaaggacgccctgatcagcatcctgggctttgtgggatttctggtggggaccttctaggccctccatgagctgatccagcctcaagacctctcctctttccaaactccactggcaccttgaaacagtgaccaattttcaactcaacatttcccgcttcacttcctaaactgacattctagccttgtttgaacaaagatccttctttaaaaaaaaaaaaaaaaaaaaaaaa

SEQ ID NO: 13 - DNA, 2456 bp, Mus musculus
ctcgagcactgttggcctactggattccagccaggccagagcaagctctccggtcagatctactgggcccaacttgcacctgcacatacacctccttgattgccctctccctaccttgagcttgccctttctgaagccatcatgtctgtgaccaagagtgccaggagtccgcaggtagccacccctctcaatctggaccttcctgagagtgccaagaagctgcagagccaggatcccagtccagcgaatgggacctcttcagagtcatcaaagaagaccaagggcataaccgggttccagacattggttcatctggtcaaaggcaacatgggcacagggatcctcggacttcccctggctgtgaagaatgcgggcatcttgatgggcccactcagcttgctggtaatgggcctcatcgcctgccactgtatgcacatcctagtcagatgtgcccagcgcttctgtcacagactgaacaagcctttcatggactatggggacacagtgatgcacggactggctttcagtcccaatgcctggctgcaaaaccacgcccactgggggaggcgtgtcgtgagcttcttcctcatcgtcacccagctgggtttctgctgtgtgtacattgtgtttctggcggacaatttaaaacaggtagtagaagctgttaacagcacaaccatcagctgccacaagaacgagacggtagctctgacgcccaccatggactctcgactctacatgctctccttcctgcccgttctggggcttctggtgttcgtcaggaacctgcgtgtcctcaccatcttctccctgctggccaacatcagcatgctggtcagcctggtcatcattgcccagtacatcatccaggaaattccagatgccagccagttgccactggtagcaagctggaagacctacccgctcttctttggaacagccattttttcatttgaaagcatcggtgtggtcctgcctctggaaaacaagatgaaggatgcccgcggcttcccaaccattctgtctttggggatgtccatcatcaccaccctgtacattgctatcggggctctgggctacctgcggtttggagatgacatcaaagccagcatcactcttaacctgcccaactgctggctgtaccaatcagtcaagctcctgtatgtcgtcggtatcctgtgtacctatgccctgcagttctacgtccctgcggaaatcatcatcccccttgctgtctctcaggtgtcaaaacgctgggcactgcccgtggacctgtctatccggcttgccctggtctgcctcacatgcatgctggccatcctcatcccacgcctggacctggtcctctccctggtgggctctgtgagcagcagcgccctggccctcatcatcccgcccctgctggaggtggtcacctactatggagagggcattagccccctgaccgtcaccaaggatgccctcatcagcatcctgggcttcatgggctttgtggtggggacctaccaggccctggatgagctgatcaagtccgggaactctcccgccctgtccaactccaccatgtttattcagtgacagagcctctcctcgcccacggtgacttatgttgtctatgaattttttcactttgccttttctctggtccaagacaggaaaaaacaaaacaaaacaaaaaacaggtgtagcatatccccagtaccgtgtgtgtgtgcgcgcgcgcgcaaaggagatgggggccatctacaccgcatacaaggtgtagatagatggtcattaaaaacaaaagaaatgttggtcgttctctagttttccacactgtggagacctcacctgtggaaaccgccatcttgtttttgtcatttatctgctaatttcctgccttgagtggagctatgcaaaaagcaaccactaggcggcagcaatagccagcttttggcagaaggtagtctctgcccgctgaggctttggttatttccttttcctgaccatgatggggaacactgtgctcaaggcagcatcaagatggagggggccagggccagtcacaatgctcagataaaatgtcaccatctatgttacagataagtgtgttgaactttctaaaccactaagtcttagcccaactcagaaatccagcagtgaacaagaaaaacatagggtcatgcctatgggccaggggcagcagacagagacatcattggagtcgtttttttacttctgaattcttgcaatgaacatcttctgttacctgtcgggcaccaagcataatacagggctcttatataatagtttgggtaaaggtgttataaaaacaagagcttatataacattgtagctttgtgtacccaacagtagagtctacgggtcatctcctgagtcttgaccttgtaacttgccatggtcaacagtaaaagtgttaccatatggagaaaaaaaaaaaaaaaaaaaaaaaa

SEQ ID NO: 14 - protein, 478 aa, Mus musculus
MSVTKSARSPQVATPLNLDLPESAKKLQSQDPSPANGTSSESSKKTKGITGFQTLVHLVKGNMGTGILGLPLAVKNAGILMGPLSLLVMGLIACHCMHILVRCAQRFCHRLNKPFMDYGDTVMHGLAFSPNAWLQNHAHWGRRVVSFFLIVTQLGFCCVYIVFLADNLKQVVEAVNSTTISCHKNETVALTPTMDSRLYMLSFLPVLGLLVFVRNLRVLTIFSLLANISMLVSLVIIAQYIIQEIPDASQLPLVASWKTYPLFFGTAIFSFESIGVVLPLENKMKDARGFPTILSLGMSIITTLYIAIGALGYLRFGDDIKASITLNLPNCWLYQSVKLLYVVGILCTYALQFYVPAEIIIPLAVSQVSKRWALPVDLSIRLALVCLTCMLAILIPRLDLVLSLVGSVSSSALALIIPPLLEVVTYYGEGISPLTVTKDALISILGFMGFVVGTYQALDELIKSGNSPALSNSTMFIQ

SEQ ID NO: 15 - protein, 51 aa, Mus musculus
MSVTKSARSPQVATPLNLDLPESAKKLQSQDPSPANGTSSESSKKTKGITG

SEQ ID NO: 16 - protein, 39 aa, Mus musculus
RCAQRFCHRLNKPFMDYGDTVMHGLAFSPNAWLQNHAHW

SEQ ID NO: 17 - protein, 477 aa, Mus musculus
MGNVPLLREVGKCQRNMFGRSTASSKGSSNSRSSSSTSPKKGPRREADALMFIQIFIHLLKSNIGTGFLGLPLAVKNAGLLVGPVSLLAIGALTVHCMDILLNCACHLTQRLQRSFVNYEETTMYSLETCPSPWLRTHSVWGRYVVSFLLIVTQLGFCSVYFMFLADNLQQIMEEAHFTSNVCQPRQSLVMTSILDTRFYMLTILPFLILLVLIQNPQVLSIFSTLATITTLSSLALIFEYLIQTPHHSNLPLVANWKTFLLFFGTAIFTFEGVGMVLPLKSQMKSPQQFPAVLYLGMSFVIFLYICLGTLGYMKFGTDTQASITLNLPICWLYQSVKLMYSVGIFFTYALQFHVPAEIIVPYVVSRVSENWALFVDLTVRTALVCLTCFSAVLIPRLDLVISLVGSVSSSALAIIIPPLLEIATFYSENISCATIVKDIMISILGLLGCVLGTYQALYEMTQQTHFYMANSTRVHI

SEQ ID NO: 18 - protein, 475 aa, Mus musculus
MSTQRLRNEDYHDYSSTDVSPEESPSEGLGSFSPGSYQRLGESSSMTWFQTLIHLLKGNIGTGLLGLPLAVKNAGLLLGPLSLLVIGIVAVHCMGILVKCAHHLCRRLNKPFLDYGDTVMYGLECSPSTWVRNHSHWGRRIVDFFLIVTQLGFCCVYFVFLADNFKQVIEAANGTTTNCNNNVTVIPTPTMDSRLYMPSFLPFLVLLSFIRNLRVLSIFSLLANISMFVSLIMIYQFIVQRIPDPSHLPLVAPWKTYPLFFGTAIFAFEGIGVVLPLENKMKDSQKFPLILYLGMAIITVLYISLGSLGYLQFGANIKGSITLNLPNCWLYQSVKLLYSIGIFFTYALQFYVAAEIIIPAIVSRVPEHFELMVDLCVRTAMVCVTCVLAILIPRLDLVISLVGSVSSSALALIIPPLLEVVTYYGEGISPLTVTKDALISILGFVGFVVGTYESLCELIQPSHSDSSTNSTSAFI

SEQ ID NO: 19 - protein, 483 aa, Homo sapiens
MSVTKSTEGPQGAVAIKLDLMSPPESAKKLENKDSTFLDESPSESAGLKKTKGITVFQALIHLVKGNMGTGILGLPLAVKNAGILMGPLSLLVMGFIACHCMHILVKCAQRFCKRLNKPFMDYGDTVMHGLEANPNAWLQNHAHWGRHIVSFFLIITQLGFCCVYIVFLADNLKQVVEAVNSTTNNCYSNETVILTPTMDSRLYMLSFLPFLVLLVLIRNLRILTIFSMLANISMLVSLVIIIQYITQEIPDPSRLPLVASWKTYPLFFGTAIFSFESIGVVLPLENKMKNARHFPAILSLGMSIVTSLYIGMAALGYLRFGDDIKASISLNLPNCWLYQSVKLLYIAGILCTYALQFYVPAEIIIPFAISRVSTRWALPLDLSIRLVMVCLTCLLAILIPRLDLVISLVGSVSGTALALIIPPLLEVTTFYSEGMSPLTIFKDALISILGFVGFVVGTYQALDELLKSEDSHPFSNSTTFVR

SEQ ID NO: 20 - protein, 470 aa, Homo sapiens
MSLLGRDYNSELNSLDNGPQSPSESSSSITSENVHPAGEAGLSMMQTLIHLLKCNIGTGLLGLPLAIKNAGLLVGPVSLLAIGVLTVHCMVILLNCAQHLSQRLQKTFVNYGEATMYGLETCPNTWLRAHAVWGRYTVSFLLVITQLGFCSVYFMFMADNLQQMVEEAHVTSNICQPREILTLTPILDIRFYMLIILPFLILLVFIQNLKVLSVFSTLANITTLGSMALIFEYIMEGIPYPSNLPLMANWKTFLLFFGTAIFTFEGVGMVLPLKNQMKHPQQFSFVLYLGMSIVIILYILLGTLGYMKFGSDTQASITLNLPNCWLYQSVKLMYSIGIFFTYALQFHVPAEIIIPFAISQVSESWALFVDLSVRSALVCLTCVSAILIPRLDLVISLVGSVSSSALALIIPALLEIVIFYSEDMSCVTIAKDIMISIVGLLGCIFGTYQALYELPQPISHSMANSTGVHA

SEQ ID NO: 21 - protein, 476 aa, Homo sapiens
MSTQRLRNEDYHDYSSTDVSPEESPSEGLNNLSSPGSYQRFGQSNSTTWFQTLIHLLKGNIGTGLLGLPLAVKNAGIVMGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLTCILAILIPRLDLVISLVGSVSSSALALIIPPLLEVTTFYSEGMSPLTIFKDALISILGFVGFVVGTYEALYELIQPSNAPIFINSTCAFI

SEQ ID NO: 22 - protein, 481 aa, Rattus norvegicus
MSVTKSAGSPQVAATVKLDLVSFPESAKKVQSQDPNPVNGSSSESSEKTKGITGFQTLVHLVKGNMGTGILGLPLAVKNAGILMGPLSLLVMGLIACHCMHILVRCAQRFCHRLNKPFMDYGDTVMHGLASSPNTWLQSHAHWGRHAVSFFLIVTQLGFCCVYIVFLADNLKQVVEAVNSTTISCHKNETVVLTPTIDSRLYMLAFLPVLGLLVFIRNLRVLTIFSLLANVSMLVSLVIIGQYIIQGIPDPSQLPLVASWKTYPLFFGTAIFSFESIGVVLPLENKMKDARRFPTILSLGMSIITTLYIAIGALGYLRFGDDIKASITLNLPNCWLYQSVKLLYVVGILCTHALQFYVPAEIIIPLAVSQVSKRWALPVDLSIRLALVCVTCMLAILIPRLDLVLSLVGSVSSSALALIIPPLLEVTTYYGEGMSPLTITKDALISILGFMGFVVGTYQALDELIRSGNSLPLSNSTMFIQ

SEQ ID NO: 23 - DNA, 991 bp, Homo sapiens
ctcgagccaagaattcggcacgaggaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaaatggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagttccctggccatcctcatcccccatctgggcatggtccttacccagatgagcttggtgagcagcagcaccctgcccctcatcatcctgtgcctcctggagatgactacctactactcagagtgcatgagctccctcatcatcaccaaggacgccctgatcagcatcctgggctttgtgggatttctggtggggaccttctaggccctccatgagctgatccagcctcaagacctctcctctttccaaactccactggcaccttgaaacagtgaccaattttcaactcaacatttcccgcttcacttcctaaactgacattctagccttgtttgaacaaagatccttctttaaaaaaaaaaaaaaaaaaaaaaaaaaaaattggtgcgggccgcaagct

SEQ ID NO: 24 - DNA, 1541 bp, Mus musculus
atgccagcagacagcacgcaggacgaggatgctgtgctctcctacgggatgaaactcacgtgggacatcaatgacccacagatgcctcaggaaccaacccactttgaccacttccgggagtggcctgatggctacgtgcgcttcatctacagcagccaggagaagaaggctcagcgccacctgagtggctgggccatgcgcaacaccaacaaccacaatggccacatcctcaagaagtcctgcctgggcgtggtggtgtgtgcacgcgcttgcgccctgaaggatggctcgcacctgcagctgaggccagccatctgtgacaaggcccggctgaagcaacaaaagaaagcttgccccaactgtcactcacctttggagctggttccttgccgagggcacagcggataccctgtcaccaacttctggagacttgatggcaatgcaattttttttcaggccaaaggagttcatgatcaccccagaccagagagtaagtcagagacagaaggcagaagaagtgccctcaagagacagatggcttctttctaccaaccccagaaaaggagatcaggggagcctgaggcaagaagcactcaggacatcaggggacacctcaatagcacggctgccctggaacccacagaactatttgatatgactgctgataccagcttccctattccagggcagccctccccttcgttcccaaactctgatgtctacagagttacctgtgacctgcccacctttcaaggagatataatactgccctttcagaaatatccaaatccaagcatttatttccccgggccaccttggggctatgagttggcaagttctggggttacaggttcgagtccatattccaccctgtataaagattcctccgaggtccccgatgacccagattggattcctctaaactcactacagtataatgtcagttcctatggcagctatgagagaaccttggatttcacagctaggtatcatagctggaaaccaacacacgggaagcccagccttgaggagaaggttgactgtgagcaatgccaggctgtgcccacattgccttattacaacctagagctgccctgcaggtacctgccagtgccagcagcgggtagccaggctctgcagacagtaatcaccaccacagtggcttaccaggcctaccagcaccctgctctgaaacacggtgacagcatgcaggaggttagcagccttgccagctgcacctatgcctcggaaaacctcccaatgcccatctatccaccagccttagaccctcaagagggagtcattcaggcagtctctccttcagggagagcccctctgaaagtccctggagactgccaggcccccagacccactctggattttcctcaagaagcagatccctccgggacagatggagcagatgtgtgggatgtgtgtctgtctggggtgggctctgtgatgggttacttagataggacagggcagccctttagctttgacaatgaggacttttaagagaaatccagggatccgatcaagcc

SEQ ID NO: 25 - DNA, 714 bp, Mus musculus
ctgcatatgaaactcagacttgaagaactgcagtccagttcatcagctgtctggtttactccagcttactacagcatcagtttgtgcatccccgaaggatcccctttgagagtcattgtatgtaaagatgatgtctgcaaacaccgtggctaaagtgatgatcatcatgctggcagtctgtcttcttacccaaacggatgggaaacccgtgaggaagagagctgtcagtgaaatacagcttatgcacaacctgggcaaacacctggcctccatggagaggatgcaatggctgagaaggaagctgcaagatatgcacaattttgttagtcttggagtccaaatggctgccagagatggcagtcaccagaagcccaccaagaaggaggaaaatgtccttgttgatggcaatccaaaaagtcttggtgagggagacaaagctgatgtggatgtattagttaaatcaaaatctcagtaaatgctgatttattctagacagtgcagggcactgacatatgctgctaccttttcaagcttatgaagatcaccaagtgctaatacttctactgtaatgaaactttggaatttttttgattacatttttgctcatttaaggtctctttcaatgattccatttcaatatgctcttctttttaaagtactactcatttccacttctctccttaaatataaataaagctttaatgctcatgaatc

SEQ ID NO: 26 - DNA, 250000 bp, Homo sapiens
  misc_feature (33774)..(33774): n is a, c, g, or t
  misc_feature (42953)..(43052): n is a, c, g, or t
  misc_feature (45557)..(45656): n is a, c, g, or t
  misc_feature (48203)..(48302): n is a, c, g, or t
  misc_feature (49551)..(49650): n is a, c, g, or t
  misc_feature (51561)..(51660): n is a, c, g, or t
  misc_feature (52722)..(52821): n is a, c, g, or t
  misc_feature (53864)..(53963): n is a, c, g, or t
  misc_feature (55290)..(55389): n is a, c, g, or t
  misc_feature (56674)..(56773): n is a, c, g, or t
  misc_feature (57879)..(57978): n is a, c, g, or t
  misc_feature (78952)..(79051): n is a, c, g, or t
  misc_feature (85316)..(85415): n is a, c, g, or t
ttgttttctcaatgttgagtattaagagttctttgtatattttagaaaacagtattttatcagatatgcctttgaaaatattttctcagtctgtgccttgtcttcttgacactgtcttttacaaagcataggtttttaactttttttttttttgacagagtctcactctgttgcccaggctgaagtgcagtggcacagtctcgacttactgcaacctctacctcctgggttcaagcaattctcccacctcagcctcctgagtagctgggattacaggtgcccaccaccacacccagctaattcttgtatttttagtagagacagggtttcgccatgttggccaggctggtcttgaactcctgacctcaggtgatccacccgcctctgcctcccaaagtgctgagattacaggcatgagccaccgcacctgccctactcgtttttaattttaaggaagtctggcttatttcttttatacagaatgccctcggtgttttatttaaaaactcattgctaaacccaaggtctccaggttttctcctatgttatcatctaggagttttatagttttgcattttacatttaggtctatggtccactttaagttactttttgtgaaggatgtaagatctagattcattttgtttgcatgtggctgtccagctgtccagcaccatttgctgaaaaggctgttcgctccattgtggtgcctttgctcctttgtcaaagttcagttaggcctctcattcctcagtaaaatgaagatagtaaataatataggaataatagctatctcatattgtcatgagaaatacatgtaaatggaaagtttattaaagcataaacaataaatggtggccagtatgacagaaaataataccaggccgggtgtgtggctcacacctgtaatcccagcactttgggaggccaaggtgggcagatcacctgaggtcaggagttcaaaaccagcctggtccctcctgggacccagagtcagcctctggctgctactccacagcgcacccttagtcgccagctaaatgtgacttcaccaggcaaccatgatgacaccgagacaggaaagcccagtccctgccttcaagttcccaatccagctgggcaaagaaggcacacccgtgggagacaccacgcaggcagtggctctgaggttgaacaggtttgattccaagcccagctctgtcgcacactaattatgataccatgaaaatatgtaaccattcagattaaaaaatgactgtcaggggccccctcttcgtctttgggaaacaatgacctggtcctcctcattcctgatgtttcacatgctaaggcccatagagaaagggtttgtctgaggtctcacagccggaattccaggggcaagaccccaaggcaggtccgacacccagtctggggatgtccacacagcacctccctgcctcccattctcctggatggggaacgccttcttaaccagcccacctccatcctctccccaccaggccccgccttctccttttcttccgcagcctgcgccttcacagattagccaccagagggctctctgggatcaaggaccagtttactgggcctgcggggaggcctaaaggttttcaggtaaatcccggcatcctaaaccactggggctcaggcagacttgcagttcaccatcgtgaccgtcactaccatcagccaccacctctactgcctccttttactgagcatttgctatgccaggtgctgtgcaagcactcagcgtcttatctcatttaattctcacaaaaacctaatgaggggccaggcacagtggctcccacctgtaatcccagcactttgggaggccgaggtggttggatcacctgaggtcaggagttcgagaccaacctggccaacatggtgaaaccccgtctctactaaaaatacaaaaactagctgggcatggtggcgtgtgcctgtaatcccagctactcaggaggctgaggcaagagaatcacttgaacccaggagacggagtttgcagtgagccgagatcatgccactgcactccagcctgggtgacagaacgagattccgtctcaaaacaacaacaacaacaacaacaaaaccctaatgaggtaggtactatcatcatttctttcgacaaatggagaaaccgaggcacagataaactgagggacccctaatttatgttagtaacttaaataaggtaagtcacagagttcatgagtgacaggaccaggattccagtccaggtcggcctgactcgggaggtgcgccttacgtttgggttcgcgaaataaattacaaatacaggggactgatgagcagcagcaagtgcaacggaacaggctgagttcagaacaagccaagagaaggccatgctaatttctaggtggcacagagccagggggcccagatttggggaggtgggggtctgctcaacttaggactcaaccccaggcctctcccgaagccctacatccacttttggggctggaccttaagagtggcacagcaactttgagcatcgctagaggagcaggccagaagggaggggcagggtggggacttgctgccctgctgtgaggagtggtttcaggagccagacaaggccttgctattggagaaggaaacgcagctgggatttgccaggacaaacggtgtaagaattgggaaacaggagaattgggaaacgacttccttcaggggctggcggatgagggagggcttgcacagttgttgttacaggggtggttttcaagcctttacaggaaggacacatatgttttccaggcatcagggcagtgctctggagggaggcacatgggatctccgaggcaggcatgaggactgggctagaaccctcaaaaagtgagcatctggggataagcaaaggcagagccaaaggccttggggggaaaacgacatctgttggactgaagattatgtatgaagattctaaaagagctagagggcaaaaaagacccagcaggtagagttttaaggcatggagtgacgcgcccagggctcgcagctggtccagtatagaagagtcaacccaacctctttgcacgacttgaaacactggtgcaatgccagcctgctagggtgccagacccaggtgctggtccatcacctgtggtgcggtgtctaaggacaggctttggaaaccctcgggcagcctctgactgcttctagaagaggggcaccagctgtttcactgaatgaaaagcaggaactttctcaggcatccagctgcaaaaagacaattttaaaacttttctcaaaattcctcaatgaatccaaagtgtccaaccaagaaaggtgcctggttagattgatacaaagctgacaatatagtgatgtcacctccttaccaggccagggcactattcactacagaaggagactacactgaatttagtaaccaaagatttcagatacgtaattagcccccaagggcagagtgggagtagatttcatctgattgatcagtgccctcaggcagctcacaatctggggaaagtggccgagcagccacgtctccagcgcaggcaggtatgaggataaccagaggagggaggtgacagcattgctgaggagggagctgtaaagttctgactgaactggccaggatgggtccacaggggcccagccatctgagctgggtcttaaagcagagcttccaatttagcacagaaaggagggtcagctaggctaagggaaaatcccaaagggaaggcctagagattttaagtatttgggcaatggtgggtagttctgacagctgggagtgacttatggagggcagggtgcaaagcaggctggagtcaaaagacaggcttggaaatgtgccgtgctcagtgaaggaggtgaggaatgaaggaatcaactggcaggggagaagattgcagcagcaaggacgtgaggtttgatgtcagacagacctggcttcaccgctttggaaacgtgatcttgggcaagtcatttaaccttttatgcctagtttgcaaagtggggatattaccagtactttccttcactggatttgagtattaaaggagacaatatacataaagtgcttagcatagtttgtatactgaatgttcaggagatgttagagatattttaccattactactgaaaaagcagctcattgtgtagtatccatattgacacactttcctttgttccatggccataataaaaggacattcccacccccctggccgtgcgcagtggctcacacctgtaatcccagcactttgggaggccgaggtgggtggatcacctgaggtcaggagttcgagaccagcctggccaacatggtgaaaccccgtctctactaaaaatacaaaaattagtcgggcgtggtggcaggcgcctgtaatcccagctacttaggaggctgaggcagagaatcgcttgaacccaggaggtggaggttgcagtgagccaagattgcaccattgtactccagcctgggggattagagcaagacttcgtctcaaaaaaaaagaaaaaaaaaaaaggacatccccccagctaaaggtaggtgggcaccaaatgttctcaggcattggttcctggcagctgaggtgggcaatttccaccccatcccccactccagccaaggggatatttggcaattctggagacatttttagttgtcacaacttgcagggtgcaactgacatctagtgggcagaggcccaggatgctgctaaacatcctagaatgcacagaaaagcccctcaacaagaattctgcagccccaaatggcagtaatagtgaggtaaagaaactctgtcctaaagaaacccacgcagcctttctgtagcaccagagcagccggaaatccagcctggggcaaaagtacccttatgccaaaaatagaagttatgcatatggctttgctcatttctaaaaaggcaccattctggattctacatctgtcagagtaaatatcagggtgagtgaaaaatgaaaggcaatctaacaatataaagaatagtatacaatgatcaagtaggatttattccaagtaagcaaggccagttcaatattcaaaaatcaatcaatggaatccaccatatcaaaaggtgaaaaaagaaaaactatacgatcatatcagatacagaaaaagcatttgacaaaattcagtactcattcatgatttttaaatatctcagtacagaaatagaggggaacttctataaaaattatactacttacatcatacttaaagtgaaagactgaatgctttccctacaagatcagggactggactaggatgttcactctcaccactttttttaaactggaaatttgaaccattgcaatatgacaaaaaagaaagaaagaaagaaaagagatagacactggaaaagaagaaatgcatctatctctatttgcagacaacatggttgtctaaatagaaaatctcaagaaatctaaccaaaaactcctagaattatcgagtacagaaaggtcacaggatacaagattaaaatacacaaatcagttatatttctatatactaccaatggacacacagaaactggaataaaaaataccatttataattgctccaaagaaaattaaatacttaagtataaatctaacaaaacacaggatctgataaatggttaaaataacaaatagtgtcaggaaggatcacctaggtcagaagttcaagaccagcctgaccaacatggcaaagccccctctctactaaaagtacaaaaatcagctaggcgtggtggcatgcacctgtagtcccagctactcgagaggctgagacaggagaatcgcttgaacccaggaggcaggggttgcagtgagctgagatggtgccactgcactccagcctgggtgacagagtgagactgtgtctcaaaaaacaaacaaacaaacaccacaaatagtggtaacaccaaaggctggcaaagttgcagaggaaatagatcactcatacattgttgctggagtagcaaaatggtagtcactctggaaaatggtttagaagttccttttaaaacgaataatgggcttaccatacgtactagtctgttttcgcgctgctgataaagacataccagacataccagagactgggcaatttacaaaagaaagaggtttaattcgatttacagttccacatagctgaggaggcctcacaatcgcggcggaaggcaaggaggagcaggtcacatcttaagcggatggcggtaggcaaacagagaatgagtttgtgcagggagacacccctttttaaaaccatcagatctcgtgagacttattcaccatcacgagaacagcgcaggaaagacatgcccccacaaatcagtcacctcccaccgggtccctcccacaacatgtggaaattcaagatgagatctgagtcaaaccatatcaccatacaattcagcaattgtgctcctgggcatatatcccagagaaattaaaactgattttcatgcaggaacacttgtacaaatatttatagtactttatttgtaataactaaatccggaaactgcacatttctttcagtgactgaagggttaaacatcagtaccatggaaccctactcagcaataaaaagaaaaaaactattgataaatgcaacaacttagatgaacatcaaggaaattatactgagtgaaagaagccaatccccaaaagatacatatggcataattcaatttattgaattattattattaatttcatgaataaaattatagagatgaacagattcgtggcttctggggaaggttagggatgtgggggactgaagggagtgggtatctataaaggggtagcataaggagtcttgaggtgacggtacagttaggcatctagattgtggtggtggtgtatacaaagctactcatgataacattgcatacagctatacacaaacacacacacacaaatgagtatctgtataactaatgaaatctgaatcagctctatggattgtgctaatgtcaatttcctggtttcaataatgtactacagttatgcaagatgttaacactgggaagcccagctgaagagtgctctggacctggacctccctcctgtgcctttgagtcttcctgtaatctacaattatttcccaataaaaaacctatatcaaaagaagtagatgactgaattttaagaggcaaaatatttgaacaagtacttccttaggccaataagcacgtaaagaggtgcaaaacatcactagccattggggaaatgcaaattaaaaccgtaatgagatgccacttcacacctattagaagggctaaaatttaaaagaccacaatattaagtattggtgaagatatggagcaactgtaactgttatacattaggaatccaacaaggaacggccactttggaaaataatttgccaaaagttagcacacatttcccatacaacctcatcatttcacctctaggtatttactcaagagaaataaaaacataggtctacacaaagacctgtacatgagtatttatagcagctttattcataatagtaatttttttataattaaatatagagtatatgtgagcccaaaacttgcgaatggccactgggaagcacagattcaagttgccctcataacatactctgattagcagcagttagaagtgagttttaaaggaagaaagaagaggtagtttctaaattgtttaccagaaatttacattaaaataacataagccataataactaaaaatttgaagcaacctcaaagactatcaactaatgaatggataaacaaattatggttcatccacgcaatagatactactcagcaataaaaagaaccaattactagatacatgttacaacatggaggaatattaaaaggatgattatgttaagtgaaagaaaccagacacaaagggctacatatgttacggttttatatgacattctagaaaagacaaaactggagacagattaaacagattagcagttgccaagggctgagtggtgtgaggatgggattgattgcaaaggggcacaagggaccttctgggggcacaaggaaacattctgtatcttgattgagatggtggtcacatgaccaaaacacattgaactgcacatttgaaaaaggtaaatttaaatttaattacatgtaaattatactccattttttttaaaaaaggagaccaatggccaagggtctagtaaagcatacccattaaagacacacatagttcctcagcacaaccgcaatgggcgaagtatgaggaaggcaacctacatagcaaagagccccaggcttagggtccaaattcagtccactgtcactcaggtttatgcctccagtagtaatgcaatgggcttacctgagggccctggctttctggaagaaggggttccagccattaggtataaatgtgagcagaaataaaaaattcaggaggtagacaacctaaaagaggattgagtggcctccacagaggaagtgagcaagacatcagtgcatggatggacagccagaacaacaagcagaagtattttggagtcctggttttctacaagtcagctaatatttcagaaaatgtttaataagccctttgtgattatgacatatggcactttacaacattctctctaaccctcaggacaattcccaaggcaaaccttcctcttgaggctgcaacagacaggcagccagcgccttgggaagcactcaggttctggaaccagaagacttgtgtgtgtatcccaatgctgctacctactagttggtggcttggcgtagctgctaaatctctttgaccttcctgttccagaaatgataatgacaacgaaaatagtcagactacatgcccaccttcctctcttggtaaaatgttatactttaagagtattctttgaaggctctgttttaaaacttatactggtaaatgtattttcctgagttctatgagctactctagcaaattaattgaaccccaaaacagagtcatgggaaccctgatttaaaatttttagccagtcagaagcacaggtaaacaacctggtacttgcaattggcactggaagtggtggtggtgggggtgtcactcttggggactgagccctcgtcctgtgggatctgatgccatcttcaggcaggtggtgtcagaattgaattggagcacacctggctagtgtttgccgcagaagtgattgtatgcttgctggtgcgaacaaattctcaagtattttggggggcggggaaatgtattgagtgagagaataaacattttaagccttaagtgtgttttcccactcagtgacaaaaaggtaagggaaggggtgtcatctcttccattgtcctgtcctgaaattaatctccacatttcaagaaaattaagtgttacctgttgtgtccggtttcttcagagaaacaaagccagtaggagatatatatatacacacacacacacatatgtgaacacagatacacatagagagactgagagagagacaaatcaaggaactggctcccatgaccgtatgagccggcaagtctgcgagtcatagggcaggcctgtaggcaggagctgatgctgcagtctggaggcagaatttcttctccaaggaaacctcagctttgttctaaaggcctttatactgattggatgtggcccacccacaatattgagaaaacctcttttacttaaaggcaactgattatagatgttaaccacatttacaaaataccttcgcagcaacacctggattagtgtttgactgaattataagttgacacatataaaactggctgtcatgtgggctcatctgctatgcaaggagagggctgaaaattcttactcaagttttcgagagaagcaggaggaggtttagggaggggaggattgtctaacagaaaaaaaaataaaaaaccattcctagtccgtttcttcttgggcgactcttaattccatggatgggtctactgcttgtgccactttgccatatgaactctgtggcataagccggaaacatttaacccagtatctagtaaagggatctgagtgatataaaaagaaaaaaaaaaaaagacacagatagcaacctctcaaaaataaaaataaaattcatttattaaaaagaaaaagcttaacatacgatccatgtgcaaaccccaaaacaggatctacgaactctggcatgatccacatcgctacacataccatgctggaagtgcacatccacacaggcacataacatacacagtactgtctagttatcaacacctacagattggttgatttttcttcacacaccattgacatgttttacaatagagttaccaattttattatccactgaaagagcatagcttcccccagaatcactttgatttaaaccaaataacacagtgaatgacaggcaccctgcacctatatctgctaccttccttactctgataacctcctaccagcaccatttatgtcctctggccagggaacgactcagtggcacaaaggaaagagaagaaatgttacaggctgatgctgtcggggcaaatagccctgcaaccagccggacttactgtctaaaagtattaaccgtaatttcaaagacaaaccacaccccttccttttcccctaatggcctcagagatttgtaatgtactttggaaaattaacttctaaggcagagtggaagccaacctcaagtcctgccacttggactctgtgtcttctcttcgaggaagcagcattgtgcacccagcgggggcagatgctgaggcttgccttaacatctcagcagctacaaaatgaaatccactgatacagaaccccttgctgtgagcagtgaggagagagagctgtaaacagacacaaattgagatttttgcacttccaaaaaatacgaggtgaacattagtgctaaacagagagaatgttctaggaagggagaaatctgagaagagaaaagtaagatgagagagaagaaacatgatttttctaatgtacttgtttgagatcaacactttaagactactgataaaactaaatttcgtggggatagacagtgagcagtgagcatcagccagtgaatctggctgcagaggagagatggaattgggcggctgaagtgaaatgatgccacacattcacacatatctagccagggcttgtgcagatgaagggatcttagcagctggacagcagcacaacataaataatgccacttgtgaatggtgacaactgctaggcagggtgaacagaagacgccagctcacactcttcctagcaagtgcctgcatttaggaggaggtgcactgcccactgagagctggaagcccgctcccaacagcagcatttggaggacagaaccaccaaggggctctgagaaagctacctctggcttggagaaattggggtgacaggagcagggtcacagagcttaagagtatctggccggaaaagcccacggtttccctttgctccagcagatgcagcctcacactcccgaaagcctttgctccgttgctctgtgatcatatttctacttatcctgggaagacactggggagggctctctacctcaagaagccctttgggctgcataagagattctgggctggctgcgagctgcttgcataagaggaggaagggcttcctcccactactactgactggctgaccctttgcttgatgcctaagagctgtgcacctgcatagccaggaaggtcctctggctggagctgcccttcctgggtcttctgaaagagccacgcaatcagtctgtcagtgtagcaggagcacaagccagagatcaaataggccatgccaaattggcttccagaaatcctaaagctacagccaactctcctacataccacgttctcacggccaggggtgtggaagcaatagcctgcatcctgctaagagctgggggaccccagtattctaccatccagtcctcaggtcccaacatcacagtcccaatctcagaactcggatgggcaggatggtctctagcagctctgagtaaacagaaacgtccaccaaggaggacatgggcaggacacaggtctggccctccagttggcatctaccttctcactgagaccactcttagcaccgctgggaaagacagctaagatagcggctgggctgccagagcccgaacttggaaccaggagatgacagtttctgagcccactttggtaacttctaagcctgagacttcagaagacagggcctctgctactcccggctagattcctggtcacatagcacctgttaagagtccaccatagaacagaaagggtgggtgaaaatcgtccttctcctaaggaagaacaagtcaacaatgatagcatattcctaagttaacaaattattaggtaggttgggagtcactacaatgagagtccacttttcccatcccttcacctggaagtcagctctcctggctttggaacagaagagacagaaaaaactggggccatatgggtgggtcacagcccttatgagctttggcgaaacacagaagcaaaacccctgatacatttttgctgctctccttcaaccagctttcagagtgaactgtatctgcagtgaagcaagagcctggtgacgggacagaagagaaaaggagtctggtctgttacttacacaggaacacacacacacacgcacgtacacacacatgtgcacaaatacacagctaaagagggggaattcatcaatggccttctgaaatacttcgcacaccaagaggaaagaagaggcagcccacagcaaggcaatgtatcttcctctgccttctctgaagtttgctcccaaatctgaaggctgaccttgaggagggccaacctcaaggctgtttgtgaaacccagggaggcattctgggggaaagacagggctcataattagtgttcagtgggttcctttcaaagtccaggccacagaggcagtgtggggccgggcactggttctgcccttttccccactgattgtaaacaaccgagcactgcgcgtagtgtcagaccagctgctgtaaagtctattaacttaatttcaaactctgtgcacactgacctcagctactcatcggtggcaatagagctggtgtcgtcccagcacgatggcaacagagcattgctgatcctttcacctggcgtgggctgaggctgaaacatgggcctgcatgcacacagccccattttatacgcctctcactcagccacccttccctcggcccggtgcacccatacatttctgcagtccttcaatgtcttttcggtatgaaaccaggctggtcaacaggaggcaaaatctgtgcctcctcaccgaggtacatttttagacgatcctgattaaaacctttgagtcctcagccaagagtgccgaggacccatgcagacatctggagcgagcttcttttcagcaggagaagttgagtcaaagtttactgaagaagaagtgattcgtaatagccccagatctaagacagtctaaaaacaaaaatctgattttaaataaaagataaatattttcagtttaggcaacacttcgtatgttttaagagctaaagcaactaagaacacagtactgtgacccacactaaggaatccagggaagagaagcattgccttaggggtcacagcaagccagagagtccagattaaaaactccagcttgggggcctgtttcaaatgaccaggtaggttcagccaccccctggagactcgaataggaagaatactgagatacaacatttgggagagagatgagaaagaagcccagctttataaagagggggcgttcccagttacttaatctatgcctggcccagaaaaggtgaaaacatgaggtgggggacatgaaaattgttaaataaagtgaactgtgcagtaagaatgagttgggcgaggtgcaccagcagaggggaggcaggtaggaaggaggaggcatgatgagggggagctggaaagttctgggtgtaaataggtacaggtgagcgatggcagccctgtcactagtagcacttctgcgtgtctgccaccccacctctcccctgccctcaggttacctggcccagggtatccaggtgccaggcagaggggttcccacacagcaaccctgactttcctcagagcctggaccatacctgaggctctgaggacaggtaacgggggacacatggggcaggggtaggcagctgcagagacgaacccagatccctatatgaaggcacaggtggaattgatgaagatgggagcattgcttggctggatcagctcatagagagcctcataggtccccaccacaaagcccacgaagcccaggatgctgatcagggcgtccttaaagatggtgagggggctcatgccctctgagtagaaggtggtgacctccaggagcggtgggatgatgagggccagggcgctgctgctcacggagcccaccagggagatgaccaggtccaggcgggggatgaggatggccaagatgcctgcagggagagaggacatgcctgtttaagatgcccagagctgggaaaggtctgtctccctactgttgagcgaattcagcatctgtccatcttataggattgagagctctaagaaaacttagacattgtccagttcaatctctgtgaaatagatgcccagaaacgtggaataactggcgtcccactgcaaggtcagcagaactgggaccggaacccggatcttctggctccggtccccaggctttcagcttttccggctacagcacatgacttccatctttctgtgcaaaaggaaccaaattacatttcaggtcaatctggtttctacccaaggagggagggtagggagaagaaaaggaggtggacgttcctgagcagctgctcattttcttaccactcagggagcctccaacacaaacatctctacctgactgacaagaaaccaaataggaaaagaaaccccgccttctggaaagacaccgtgataaaaccgcatttcacagagcattttgatacaggtgaaaaaaagcagttctatctgcaggctgacccctggcgaagccccacacgacgaccgtatctctgtgacaggacacccactggctctcacatctgaaactcagccacgggtgagcgaggaaggaggaactgacgaagaccaatggtgcactgccgcaggaggtgccatcggcttccgtgccataccagccattgtcaacactgccagacagtgctgtaagcaggaggaggcttcaccgaatacacccatcctagtgcccactgaccccacgcttcccatctcaccgatctttccaccaggtgggcaaaggccagtgtttcacaggtttattgaggcctgtgggctctggaactaggttcttgtgttcagatcctggctctgctgctaattagctgagtgacattggggaaggtatggtacctttctattccccagttttcttgttggcaaaatggggatattaactgctcctgaatcatagagatgtcatgatggtcaaatgaggttatgcaggtgcctcacaaaaggcctggtgtacagtagggatgtcttacctgttaatgttatcatcattagtattcatctttttggccatgaaaagtacatcctgctacagtgcatgacttcctgttagttactaacctgttagcaatcaaatatagtttgacagattgtctttcctactgctgggctacagctggatgctcccagccttgatacagacatccagagcttatctactacctcattgattcctacgagagggttacattttatatgagaggtttgcttctaagttcattctgtaaagtgaaaatgcagtcaagtcactctaaggaaggcaccacactggtgagactgccagaacatctcagtccaaggcagccaatgtctacatcgatcactgcttctttggctgagcacctgaaggattggattgcatttagagaccagatttttaagaaacactttaaactgaaatgtctaaagttgatttttgaggagccataaaaacaaacaaaagagaatagcactccctgcagtaagatgagagacatgtggaaacaaggacttaccaggtaatatggtttggatatttgtcccctccaaatttcatgttgaaatgtgatccccaatgtcagaggtggggcctggtgggaagtgtttgagttgtgggggcaaatccctcatgaatgacttggggccctccccgagagagctgttgtttaaaagagcctggtacctcccttctccttgctccctgtcttgccatataaagcctgctccccctttgccttctgccatgattagaagcttcctgaggccctcaccagaagcagatgctggcatcacacttcctgtacagcctgcagagccatgagccaaaataaacctcttttctttataaattacccagtctcaggtgcttctttataacaacgcaaatggactaacacaccagggaaagaatggattcatgcctcctgcctcacacttaccctggagctgtgctgtccaacatagccacggacggctatttacattgaaatgaattaaaatgaaattaaatcctgttcttcattcacactagccacatttcaaaggctcaacaaccactggtgcctagtggctgctgcaatggacagcacacacatgggacatttccattcatttccattactgcagaatgtctagtggtacccagcagagagcactgctaagcactcactagtggaggtgaatctgcctctgtttcacaggtatgtaactccacaatattactacagtcctatggaaagagaggcccagagggtgtaaacgacaggaagcaacagagctgggaccaggatccaggacctcaagcccctggcccataacctcacagacctgatgggcaaggaaatgcagagggaggggagacagggagtctggcggatcagtggaaggatcctgcctgtgaggaaatgagaggtagatacccaggctagctttcacagggatgcaccatggtgcatggtggagaacccagcacacgatcagccctgacctctttctgctttgtcaagtggaattggacaagggatccaaagcctgacagcaaacgggtacaaggatatcgagtctcagatccacctctgccacagtgttatatactctggggcagttcttcatctttccttcttctattaatcaaccataatggcaattctcattaacatcttcaccgatctcaaggctttgagaagtgtgcaaaaagtttaggcttttaatttccctgaaactcaaaactactatgttttcagcccttagctgcttctaaatagagttggtgacatcccccaaaccttgagggttgaatatggagaaaattggaggtaaaattgtaggctgatgacaaaacagcattctcatcataggtcatctaacgctcaacaaaagagctggtctgctgtggtaccgacaccaagacacttgccctctctggggtctgggtctccctgcctaatgtcatccttgcagtgatggtgccaggtgttactgtggggtggaagctgcactgaggtaacaatcgggagaactgagccccagggagagggtggtataggaatgggtgtaggctctggatttggaatgcccaggctccaacctcagctctaccactcagtggctagttacctaaactctttgagactcatttccccaactactaaacaggatggtcaaacgatatcactcatgtaaagaactcagcgttctaaaaaccaataataaatgcttcaatattatcaccagtccctgctccataacaagctgagtggtgcagggcaaatcagcttactattctgagcctcagttcattcgtttacctgtgaaatgtggtaactgggtgatgtctgaagtctcgcccaactctgaaattctaaggaactatacactccagtgttagtcacttaggactgtgttctgggatatgttcctcacctcactgacaactgggaagcaccacgtcctgcctgagggtggcacagcaaagcgatggggctccaagcctcgaacacatggcttgcccaaaagggagcttctaacccactcggttttgtatggataaaggaagtgtgagttattccttcagtcccagccacacaagcatctccacaaatgctgatgtccgctcaagagacaggaggcctttattatcagagaaaatgagtccctggcaggagacaaatcagagcctttcccagccctgagagtctgtcatctccccaccctctcccatactgacctagcaggacatatgggcacttcatgatagttaagtggagtcagagagatgctccactctgtggtgggagttaagtggaaacagaaacagaagattgggatcagaatttttcctctgattggacaaagatcttccgcttcatcatgatattttataagtaatctaaaaacttgttcttgttttcaccactatataagataaacatgcctaataaaaatatccttaatagagattttaagaacatttctctcctcttaaagccaggaccacagggctgcaaagggaagtccttcttcctgtcctagctgaaccacataccaccgctgaaccctacatgaagcgtgacactgcagagggcaagaagagcgagcctcccactaacacaaagtgggaagaagagaaggatgtccaaaccaaatcagcatcagcagcccccagggttcaacagcacgggtatctgttttgccaccatggaaaatgactttaactaactccagaagcagcaatcgactatgcagacatgtggggcaaataaaaccccttctggcactaaatgtcttctgtgagttaaagtgcctatgaagagacactcaacaaggtagatatctcaggaagcagccagccaggaacagccctctccctactctcccctaatcccccccgcccccacacacaaagaccccagcccagacaaaaaggaagacatttgtataacaaatgcagttatacacttctcagcagcagctcagctgtggcgtgtacaaaaggggggacagaggacaacctcagctcgaccacatgattagtcaagagggctccaacagtattacaaaacatcttcccttcgagtcaagagacacaaagaatatgagcttttaaactgctgaagcaacataaggccaacagtcatgttcacagaaggaactggattctggagcctgtggttttgaaccagcatcagaaagagctgacttatacacaacaagagcaaagcactgaaaagaacaaacgcgaacttacgaaatacgctggccatttatggctcctgtgctgggagctcttgctgctattttattatgatcaaagctgttaaaacttaccaagttacttttatttatttatttttatttttatttttattgtttttgagatggagtctcgccctgtcacctaggctggagtgcagtggcgcgatcttggctcactgcaagctctgcctcctgggttcacgccattctcctgcctcagcctcccaagtagctgggactacaggcacctgccaccacaccaggctaattttgtttttgtatttttagtagagacggggtttcaccatgttacttttaaatgtctataaatatgcctttaaaattcatagtagtcttggacagtatacaaagtttgacttagtgggggtataaatttaaaaaatacgaaaacaagggaaacaaccaccatgtccaacatgaaaggagtaccttagttaatatgatccaccaatacagtggaataccacgaggtcatgaaaatattagtgaaagatatgaatatttgtgatataaaattaaataaaatgtgaaagacaaaattatgtgtaaactacaattgcaactacttttacaaggcacccatgaggattaagacacagaagatacaatgcaaaaaaaaattactttgttaaattggtggaatactggaatttcttcttttattcccaaatgtttttacattgactttctttttttagagtaatatttgtgtagaaacttaaaatcaagcgcaaagcacctatacagaatcacagaattttggagttgagagaaaccttagaggtcagacacccttcctatcttacagttgaggaccctgaggccttatgagggttcctgggcggggaatgcagggtggggggtggcagggttacacagctaattaatgatgctgctcttcttcactgtagctgcaagactaaaaagtgtgaaaggcccaaaggtactaagaagctactctgtttggacctggaagcttcatcctctaaaaatccgactgcttggaatgttttgcagctctgcattccagtctgaacaggcttcttggatgatgcgattttaggtaattatatcttcagaaataggtttctgaaattttcatagcaaactgaagtaaaatgtttcacatggcaaatgacacagagaatcagtatgaatcactgaaggatggatgggttattgctccaaagaaatctaaaaaaccgttgatcctacaactccagactccacaggtggggccagcctcttccacacaaggtctggacataaggtgacctgctaagtccgcatttccaaaaatatgggcgggaagtagatactgtccgatatgaaatcataacaaaatgagcactatcctatgaaatacttgttttccctccccctcttctccaactgtttgaaattaagcatcacaaagtccgtatcagccatagtaatctttggaggatgggggagagtggtgagaaagttgaattccaagagggaaaaaaaaaaagaaactacactgaattcctcctgttccctttggagggtgaagaggaggaggaaaagttggggaaaagataggaaaacaccagaaatagtaataaaagaagctgctgttaaaatttatgaatataaatgaaaaaaatcaattaaagatctaaaatcacatactaatcaacggtgctgaaagatctgaaagaacagagaagcaagaacaaaatgaacgcgcataaatacatttaagttgctgctgccatgaaaggcctctactgagtcccacaattacttcaaagtctccaaggaaggtgagagaggcgagtgctctcagacataaagggggctgcctttttgaacaggatgacaatgcaatgctaagtcacaacagatcacagaagggaaaaacaactgcacacacttgaagaccaaaagcagccgtgtcttctgagcatcgtcctgttgaagggagatgagactcacagacagggccaggaaaagtgaagcaaaatccaagaggcatctaaggataacatgaggtctgtgaatcagagactgctgtctcctgcagggtgctgcagaaataaacctggcaggaagtgtgacatatgctacagggaggctgagccaggctggaggggaaaattgggcagggagaggagtcaggctcctgtcactgccccagctcaataggcagggtggaggagctgtttagtcaggaaggcacattttacctacagagacctactttttccggagggagcactttggataaaagcaaattatttgaactaaccacactctttcttccagtgccctttagatttaagaattgggccctcagagtttacattataaataccatacacgtgaaagctgtctcctcaagcacttagagctactccatccacggtggaaacatacactttggaatcaaagcatggagagttactggcacaagataggattaaaatttacagtccaagcatcccatcttagcagcacacattaaggcaatctattagaaaagcaggatacatcatgttccttctttttcagtcgctgtgggaacagcagctggctttcaacagccctggcccctggattagctgctgcgtgggctgtttctatataggctggtctaggagagggcctgaaggagtgactaagagcaaatgctagacaactttcccatctttcatccttaaaacattcaaccctaattagaatttaaaaagtcatatggatctatctttatcccaaagacagaggctcagactgaataatttaagaaaattctcagggaagtctcaacataataagcaaagaggttcttgttcaaaaataataaaacctaaaaagagaaaaaaaagccaaatagagccaaaaagaggaatctatgcttttaagcatttgaatttggaaaacaattgcaaatctcttagaaacttaaattagctattatcaaccgatttgctcaggggttctctagtctaccaactcacagaagctacaaaaaaaatttacttttattttctaaatgtcaccagttttcaaccacagcaaacagaagggtatcctgtcttttaacttacactcctgggaatggggttgagagaagaagaataaaacacaagtgatcaatcaaatacctaggttaatcaatagaaattttctgaaacatatttagtaagactgacattaaaaaatgtctagaatactatcataaagcctctaaaggaaatctaaggagcaacttgtcacagtggaaaaacaactatttgaaaaagcaaataagtacccttcatcagagtaacttatactcattacagatatgggttaaatggctttcagacctttaccttatttaatatgggatagtaatcgcatgtctttactctgaatgataaccacctccacagcatttcataccctatctatacataaaccactgtcctcattcccatgttctttacagtacatatgtaattaattcacttccccatctggaggtgcctcaactctgaaagtgaggccatgggccaggttctctgtcacaaacatacccagcttcactacaacacacattgtcttttctcatgaaagcctgcagactgggtgccctttagggaaaaacaagcaaggcaattatcatcttctactcacatgtcaggcagaccagcactgtgcgcacaaacaggtccaccactaactcacagtgctcgggcgctcgggacacaaagaaggggatgatgatctcagccgggacgtagaactggagtgcgtaggtgaaaaagatcccgatggagtacagcagcttaactgactggtacaacctgccgaaacagacaggagacattccaagcctgctcagcacacttatacatcatcagcaagagtgcaaaatggtcccattgcgatttgttgacacttatcaaggatacaaacccacatgtccttcggacccagcaatttcatgtctagaaatttatctcacagatatcctcacacacatacacaaaagcttatattcaaaatatctcactgcagcattatttaagaaggaaagactgaaaacaatttaaatgttaaccagtgggaactcgataggtaaatcgtggtgcccccgtatagcttttaacaaagtatgaggcagaactctaggtgtgatggtgtgatatgaaactatccccatgatatatcactctatcacatgatatagcatatcactatcatggggacagttttatatcactttttttaagtgaaaaaagcatgaagcaatacagtacctacagagtgctacaatttgtcttaaaaaagaaaaaagaggaggaaaaaacacaccctcaccccacatgacaatcatacactaaacatctcaaaacaaacaaacaaacaaaaaagaaactgggaatatggttgcctctgaaatgggaaattgtaaaattgggaactagagtggagggcgcggggtggaagcttaatgctctctatataccttttgaaaatctcaatctttgccatgggcatacaggtgtacatgccttcaaaaataaaaacaaaattgcaattaaaatgtcacaagcccatttatatctgtcccatccaagtcagtgtccctagaattagatgaagacactgcaggaccaagaggccagagcagaattccatctttccataccactatggctctcttcctactactgcttcaagtgtagcttccaaaaatgacgtaactcaccacaggatatccctattttattactccagtgccttgactgcacagagtaggaaaacagtctgtgatcaacttacagatctgacctggtcattaaaaggaaaggtctctgtccctaagcaaagctccacgcttaaaccagaccctcatgtgttaaacagcaagaaacatttgtcctcccttgtcggaaatctatttaaatgtgctaatacagactgtgtatatgtgccttgagtttctctgtggttgaatttaaaatctagaagatgttcttatgctataagcaggagaacaaccttgtaaagactgagtctggtaaaaggtcatacttgctccatgaatagataataaaaactcttgggaaaaatcatctggtggctctatcattaaactcaaagcagccccaaagcctctggagagctgtgaagtctggacttaggagagtgacacctgcagggatagccaaataaattatacccaaatggaggcagaagagttacagcagctgggtttggggtgttaggaaagaagacagattctcctctatggcttcggatcatgtgggctgcttctgttgctcccgatccatttatcttccagggaaaggtgacacagttacaccaagctaccacctgcctcttccttcttggaagggcagaaacatttggaaatttaaaagtagacacaagatggatatgccaattaccctgatttgataattacacattgtacatatgtatccaaatgtcacacatactgcatccatatatataattggtatgcctcacgagttaaaatcaactgaaaaagaatataaaaaaataaaaagcgaatccaggtctatagccataccattctgaatgtgctcaatttcacctgatcttggaagctaagcagggtcaagcctggttcgtccttgaacgggaaagcccctggaaatactgagtgctgttgtcttaaaaaatacaataaaataaaacaatacaaaacaaaataaaaagcacacccaggcagatcagccagcctagactgaaagctgattctgatccgcagagcactcaacaagcttctcagtgtctgctaacagctgctctccaccatgagatgattcatcttcaaaacaggatggttgctctgcacatgccctgggacattcaccctttcaggaagcatttcaaaatggctcactatttccctataatacattcaccaatgcaagagaggtacaaaaggactcccaacaatccccggctcacagtgagatgctcccatctgcatatcaagcctgttactaccaagggagaggcacaaccgatgctgggaatcaaatgcaggtttgccctcccatctccctgtctatttggaatggtttaccatgaatggactagatactcggtccttctgagcttaggaattccaaggagaaatggcttacccatcggctgatcagcaccaatggcttcagcagaaggctctacatgaattccccaaacagaatgcagtccagggcagccagtgagggctggcagtggcaggggatggtgggctagagtgaagtgggctggtttaagagataagtaagagggagaatccacactgtgacccattagtttttaaaaatatccagtgctcctaggtttccatcctccctccacgtaccagcagttgggcaggttgagggttatgctgccttggatattagctccaaattgcaggtaccccagacaccccaggctgatgtagaggatggtgacgatgaccatgcccaggtacaggatgagtgggaacttccgaggatccttcattttgttttccaggggcagaacctatgagagagtagtgagagaggagagaaagtgcagaaaaaagcaaagttaatggccaagaaaaaaaaaaacctcagaaaaaaagtaactcttttatccccagaattctccagaagcacatctgctctttaaataaagttatttcatcagacgttatgctcttgggactagaagggactctgcagcccactgcctagctaggaagtcctaaaagtaagggtggacaggacacgagcccaggactcctggctcaggccagtgctctgtcctcctgctgcaggatccctgcaggctgggaatgtcccttgccctgtgagtgaggccacatggcaaccagaaggccctctcatgtcatgcccacctggcatctaacctgagatcacagcttcctgctaacctgtctaaagaatgcaaaatataggtcagggaaaactgccactctagctcaacaggggcaagcactagcagtgacaagttaaacctccaagtgagagaaactgcagtgcgaaagaaagcatgacttcgtagaggatctcaagacatgggtgcttaacaatgcccagtttccagactcctattacaaaccactgacctttgctacctccttcatcataagagaggacattctttaactttggtaaaagcaaaggaaaggcccctatgaaaatgagtttatttaggaattgggaaaatggcaggtgtgactgtgaggatcttcacagtctgccatcaactggatctggcacagctaataaggaagagcaacactgggcaatgtctagctgtgccacaaactttgatcttgttattacacttattttcctgcagcacctgcagccatgaggcacaataggtctgtgctgcacacaccaacatgatcctgctgcaggcctggtgctcccaggggcccccagtgtcccccaccacctgctccagcttcagttaatccacatccattagaaacagcttctaaatgtatctgtcagtttccatcataccaagaatacaaagagccagagggcagggagcccatatctggcctgtgacagctgcatgaacacagagcacacggtgaatacagtgtgcagcctggcactttaccccgatgcaatgaacaagccctagatccaaaactaagagtcaatctagcagtgttctctctctattgtaaaaaaatagaaatacaaagaaatcttgaaaacaaatgatgtttgcagaataactttgtgtacaagtcttgggtaataaaaccaagcaaacaatttctgcactgtgctgttagggaaagctactaaaaatttagcacaaggtcccttaggatgcccaagaacctaaggtctctgggcatctttccacactttctcagcctcttctttccagtcctgagttcttgggatctctttctcactgctgaagtatgggcccactcaggcctctgccccagcagcaggaaaccatttgtgtttctgaattacagtgagacactcttcatgggcaatgaaaagccctaagatagagcacagggcaaggtataaaacctcagggagaccagtgatttacatgtgatcactcccaaagcctcccccatgatgtcagagcttcaacgtgttccatcaacaccacctgggtgatttctcacgattttgacaaaaaatgtgtacagcttctaggttttcttaaaagcaaataaggtgtctcggaaatcaaaaaagagaaagaagtgccgtgccgggaggaggctcttcccatttgtggcgcccttggccaggaataactttcttcagagaagagttttgtaccattattatgaaaaatacaaataaaattcaaattaggtaaaagtgaggggtagattcctttttaggaaaagcatttggtgaaatcacagaatgctgagccaggagtgaaggctgctcttttgcacgcagaaaatacaccaaaccaatgttgtagggcagagaaattattcatgcatttattgattcaataataaaataacattattaataaaataaaaatctattaaacatttaccatgtgtcagggtctgtgcaaagcattttgcacatatctcatttaatcctaataactacgaatcattaagctcacttttcaggaacaaataatgaaggctcaaagagatgaagcccttgctcaaggtcacacagctactctatggcagagccaggacttacccccatgtcagtctgactctagaccctgccttcctgattgccatatgctattccttactgcaaacataggagatgagtgtgcagtgaaggggccttgaatgtaaacattttaaaattacatataatttgtcttgaaaagttgaagctgggaaatctcaatggaatccccgaaacactattcactaactgaccagtgagttacagaagataatttcttttttttttttttttttttttttgagacagagtctcgctctgtcacccaggctggagtgcagtggcgtgatcttggctcactgcaacctccgtctccccagttcaagcaattctcctgcctcagcctctcgagtggctgggattataggcgtgtgccaccatgcctagctgatttttgtatatttagtagagatggggtttcaccatgttggccaggctggtttcgaactcctgacctcaagtgatccaccagtctaggcctcccaaagtgctgagattacaggcgtgagccaccatgcctggcctcagaagatactttctaacaatgtttgctcagcattccttgaaacagacctggagaacaccaagggcaccagagaacactagcccaaatcacagtgcagctcttaccattccaatgccttcaaatgaaaaaatcgctgtgccaaagaagagagggtaggtcttccaaggggccaccaaggggaggtggctggggtctgggatcctctgaaagacagaaagcaaaacaaagcaaaaggctatacagaaattcaagatttgaactctgaatcggagaggtcataccttttaacaaatccaagattctctaaaggaagaaagtctaatacctgacagatgatttagggacatttaacctttgtatgtttttctcttcaggctaagaaaaacccacttgtttgggggaaagacaagcccaaggtactattaaaaactcaaatgttggggcttgcataaaaagagtcacattctttcactaggtaatcccatccccagaaactgaattcaagtagaaaaaaaatcaaaagatgaaaaacactgagcaaagctgtttaataaagtaactgaaaacaatataagtgcttccaaacaagggatcagttaagtaattaacaacataccagctaaaccacagaatatatattctttctatctatctatctatctatctatctatctatctatctatctctatctagagacagagtctccttctgtcacccaggctggcgtgcagtggcgagatctcggctcactgcaacctccctctgcctcctgggttcaagcaattcttcgtgcctcagcctcctgagtggctaggactacaggtgcgtgccaccacactcggctattttttgtatatttttggtagagacagggcttcaccatgttggccaagctgtttgtgaactcttgatttcaagtgatctgcctgcctcggcctcccaaggtgctgggatcacaggcgttggccactgcgcctggccagtatgcactattaaaaagtaaaaattgagataactaagtagaacatgaaaaactacttacgaaatattagtgagaaaaaattttaattttaatttatatattcactctgatacaactacataaacatcaaagataaagctggaagggaagagaaagtggtacatttttatattggttctcttcctttttcctcttcttttcttctcctttttaaaattctcatcaatgaacttgagcactttcaaagtattaccaagaagcacacaacaggagtgctggaacatgtggggaggaggagcaaaaagaatgctttaaaaaatgggccagaaaaagggcaactgttaactgcaggtacaatgttaaggttgtataaggaaggaggttgtgatggttaatactgagtgtcaacttgattgcactgaaggaggcaaagtctttagattgttcctgcgtgtgtttgtgagggtgttgccacatttgagtcagtggactgggaaaggcagacccacccttaatctggatgggcacaatctaatcagctgccagctcggccagtggccagattaaaaagcaggcagaagaatgtgaaaaggctagactggcttagcctcccaggctacatctttctcccgtgctggatacttcctgcccttgaacatcagacctcgagttcttcagctttgggacttggactggcttccttgctcctcagcctgcagacggcctgttgtggaaacctgtgattgcgtgagttaatattccttaataaactcccctatatatgtacatctatcctattagttctgtccctctagagaaccctgactaagacagaggtatagtcacaaaatcctccaccgaacaacagtctccagtaacagactgtgtggaaggggcagggtggggaggagggattcaaagctgctgtctttttacaatttggttttctaaaccacatgtgtatgttgcttcaattaaaataaaaattgatgttaaaacagccttttacaatgttttaaaattgatttaactgtatggctatttggataatacggggcatgctcttaacaggcttcagaataatttcaggcaagtaaaaggagatccattattaagctctataacagccttcactttgaaagatttcaaagcagtaatattgcttttgaaaaaataaaaaaattaaataaatgtgtttccctgggcccctgctaagaaatctgttagatccctttgtaagaagcatttcaatacctggaatgaagacagggtaataggtatttttcctttacaatgggacttgagagcaagagtggcctgtaattattcctgagtcacaaatgtaacctaagttattggaaacaggtgctatctgttggttagtgaatgactcctgctcttattcatacatcagatcagattcaagtatcagactgggaatttcacaatccatatgtggggatattgtgggaatgaggccagcagaagaagtgtattattctacatacttactgattgctactgacccaaccaactaaatgagaaaagtttaatttataaagaaacatacatgttaaaatcagctcgttattaacatatctcctcaattctacaacacagtaagtcctcccttgtcgtcaataagttcttggaaactgagactttaagtgaaatgacgtacagtcacttccttcaacgctgttttgttataacattgatgagaaaaaaactgatttcgctatacatacatttaatgtattgcagtttctaagaatgtatcaatgatattaagtgaggtcttaccatattatcaattataataacagtattttgagaaaatgctgttaaaggtacacatggattgtgagatgtactcttgcaatcctgaaactgttataactatgaaaaaatacatctcagaagcaacgatatgcagtgataaaacatttattgggagcaccctctgtgcaaagcactctgcccagaactgttccatttgagactccacatgctgaagacagagaggaacctgctctctgtggaagaccttggtctgctacctacaatggcacgtgcatgaggggcaagaggaacagtcatgtacatgcttaggattagggaaaaaattcagaaacattgaacagtaggggaatcctcatggtaagtggggcacaatgccaaaacagaacagtagtaacaagccgcagaggcagcggcaacaaaaatgacctaaagggagcatctttagctgtatgacacatcaaaatgaagcaactacaacactatgggcagtgactacatcaaaacacagccaaacctcttcccccatgctgtactccaggcagacggcactatttgatcacagcacaacttctggctaagcccagaggaagactcagaattgctctcaagaaatcagcagggctgcccttatgcagacattgctctgtgtcctggttgtactatgcatagacatcactctggatggatactaccagttggttgggactgagacgctataagaacccaaattcttatcccagccctctgatcatggcaaccaccacagcccgactacctgcaatgatttaaaagtaaatgcagcaggtgtgtctgtctatgggggtggcctcactcaattcatctttagtgtacagtggagtatatcctaggtgctcttgagagttctaattacaacatgaaatcatgggtaaatatttacccttccttgtttggtaatggaaatggtctatagtgcattcacaggccctccttccagtctcataaaaaggggacgtgaagaactatttattttatgtttaaaaaaatagttctgcagaagagtcaatatctgccactcatctgacttaatgtgatgaaaaaacagtcaatactcacagagcaaaatgttaatctaaattgataatgtcatttgcttagcacaagaagtcctgctttttatgagccactgtcttcctggaaactatatcagtgggtgactgggtcactgttaagcagactgtatgaaaatgagataatattcacctgtcagactgaccaaaataatactaatataattatactatatataaatactaatatatcatacatatatcaagaatactaatataaataatactaatacatccagtattagtaaggatggaaaaatgggcacttaaatactgtggaagggagtctctatgaaattaggaaatagcttttggaaaaaacaacttggtaacataacaaaaattcaaaagtgcacactcttcagcaattacacatctagacaaatatcttaagtatttatacaagtccacaaaaaggaatgtataagaacatctcactgtcttaatactgaaataatactaaaaattatccatggcctgatagccactgagtgaggacttgttaaataaatggcagcaaatctccttgctgtgatacaatgtgacaactaacaacaacaaggtagagccaggaatactaacctggaaggctcactaaggcatttttaaggtggaaaaaagcaaggtagatgaacatgtaactttaaaaaattatgtttcaaaaatgaaaacaaaatatatttcaatgtatttctcaatatacttacatgggctgtaaatccattcacaggatctagaatgagacagaccaatcacatacagcgggtccctgagaggagactcggggtggggacatggtattcaagaggtatttgtgttgtctgcattttaatgaatatgtactgatgaattatttggggaactgaatttaagtatttttttttttaagttatgcttttatttacccgcttttacttttttccttttctcaagccttagaaaatgcattctcattttcacaaacagccatagtgtttaagggcacatttttctcagcctgattttctacccatctgtatacagatgttctctctcatgccaccccacagacttgcctgcatgggttaagtgagggcaaggaacaagtgaatttataattttgacaaataaaaattaactggagttgataaggaattacttatctaaatacaggttagaaaaattattttttattttaatcttaacattttcctctattttccaactgtataccaatgattcatggaatttaacccattctaattgaaaaaaggttctaaacccaggtggccccnccctggggtggggggggcgattttgccccccaggaaggtttggcaatgtctggagacatttttggttgtcataactcatggagggatcgctactggtacctaatgagtagagaccagagatgctgctaaacaccccacaatgcacaggacagccccatagcaaagaatttatccatcccaaaatgtcaacagggccccaagaacagaacctctaatctagacataccagtagtaacatataactatttaccattccacttacatatatatattatgtatatatatacacaatatataaatattacatacatttatataatatatattattgcatgtacataatatatattacatgtatatgtaaaatatacatgtaatatatataaatataataacatataccatatatgtaaatatatatatataaaatatatatatatatatatatatatatatagtttttgtttggagacagagtcttgctctgttgcccaggtcggagtgcagtagcatgatctcagctcactgcaaccttcgcctcccaggttcaagcgattctcctgcctcagcctcccaaatagctgagattaggcccacacccccatgcctaatttttctatttttactagtagagacaggtttcaccatgacggccaggctggtctcaaactcctgatctcaggtgatccacccgcccccacctcccaaagtgctgggattacaggcatgagctaccacgcctggcttttttaaaatattgaaccaagatgataggagagggcctaggcatgtacctgaacaatgaactggtagatcatgaccaagctgaccagcatggtgatgttggccaacagggagaagatggacagggctcggaggttcctgatgaaaaccagcagcaccaggaagggcaggaaggagagcatgtagagtcgcgagtccatggtaggcgtcagaatcaccgtctcattgttgtggcagttattggtggtcccattggccgcttctatcacctagaatgaggggaaggaagaaaacggaaacacctctcaaacaacagaggccggtggatcctctgctggaagaggttcctgaggaaaggctcaggtgtgtgaacaaggccttttagaatctgtggccagtgagccatctttagagaacttcacgactatcatcagcaacccaattgtctgagctaggtttgatcatatgtacctaggacaggagggtcgacaagacatgtggcggtttctctatgcccgagctctttccatgggaatcaaatagaagacgtagatctatgtaaaatatgaaaactttaactcttttgttgacaaaagctgatttggaaaaaatcctaaacaaaaacttcaagtcatcttttgccattctcgactctggtttatgtttttttttgcttttttaaccaggtgcctacctgtttaaagttgtcagccagaaacacaaaatagacacagcagaatcccagctgggtgacaatcaggaagaagtccacaacacgtctggaggtggggaaggaaggaatacaaagactgttacaatacaaatgcaatgctcccagaaggggaggtgttttttgtttttgttttttaatagatttagggagtacaagtgctgttttgttaaatggatatactgcatagtggtagtgcctgggcgtttagtgtacccatcacccaaacagtgtacattgtgcccattaagtgtttttttaacagtgcttttccccaagccatcacagacccttcctggcagtgacaaggacgagatgccctggcaggagaagaaaccatgctaggtgccactggtctggggcattgggaagaaggtgagggaggtgctatctgtgtggtttccgacgtccccttcctggcttctcgtctggaatgctgcatgaggtgagacacatgcacagacaccatgaccactgcccagccccttagcatcctctctacacatctgcccacctatcccatctcacacttttttgttagttacagggagcccttgacataaaacacaaggaaatagtccccttcactgtctctataacttggatataagaaccaaccaagtcccacattaaggacacagaaactgatgtaccaaaaacagactgctggttgaacaatagcagctggtaacaacctaaaggatcatcaaaagcagagtgattaaattatagaccgttcttaaatggaacattacacagcagttaaaaagaatgtgttaaatctctatgtgctgatagagaaaaacgtctcagacgtttaaggggaaaaagcaagtttccaaacagtatacatagtatggtcaatctgtgcaaaaaactttaagaacatgtgtatgtttctacttatacagcaaattccaaaaggctacccatgcaactgtgaccaaaattttctttcactttttactttatgtcctatcttgatcaaaacaaagtttttactatgagcacgcattaaaatagcacacattttattaaaaggaaggaaggaaaggagggaaggagggcggaagaaaggaagtagtaagaaagaatggaaggaagaattaacaaccacccaactcatggtggtcacctggcaatctagcttctcccagttacagaaaataatttggccaaaagaactatataatctgcatcacaggataaaggtgactatgaatgaaagtaagtttcctctatgacaacaaaaaggaacttttctagagaacatagttttaatgtggttctttttttttttttaagaatttttagcccttgatagtatcaatttcctacatttaaatgtagaaaacaaacataatatttccctccaaacactgaagagttaccataacgagaaatttgcaaatacttcccacctccaaactcatctccacaccctgctctagtttatctcaccttctcctgaagccttctttgctcctatctctcatgtgcgtttctcatctggcacagccgacaagagaatctttaaagttcctctctctctgagcactgagggtgtactcctagctcatgacactttcttcttatgggtgtctcccactactggtctcttatcttgttccccggcttctcttcccacatttctttttccttacacagactacaagcctctggagggtaggaaccacataatttacttcaggaaatcttcccttcttacctagaactgttttgttccatttataagatagtgcttaaatacatttgttgaacaaatgagtgaatcaaaaacaatcactggtcatagaccgccaaagctggaatggctctagagaccattcaggccaggccccatgctttcctgataagaaaactaaaacccaaggaaaaaaggggttacccagccccaggtcacacagcttactaccagcagagctgagccacagccccaggcaactgacccaaacagcactctttccacgcttttacactgtctcccacgttgcacctccccatctgaaggcctcacactgggaggccacagttgaaaggaaggaggaaatcagttaccttccccagtgtgcgtggttccggagccaggagcaggggctggattctagtccatacatcacagtatcaccataatccacaaaggatttattcagcctggaagagtaggagggaagaggaaggacagagcacgtggattagacaatgacaatgacagaacaaaaagagccactgagacctgggccagttcccatctttcaccctggaggtaccactctgagtcctgtatctcgtgctttcaaagatcagaagtattcagtcgacaggatggttacttttattataattaacaaccatctggtagaatcatttcaatggggtaaatattacaacgcccatgaaattagaatgtagtacccactgggcataagtaaatttaacagatgataatgagccagaaaagaacgcaaaaataaccagggaaaggaaaacgctgcaatcataagctgctacctccagccagtgtaaagaattgagagtggtctgcatcagtgctcattttcagggttgataacagaacccaaaaggacaatctgtcacttgagaggtggctcagagggctctcacctgcggcagaagtggtgagcacatttcaccaggatacccatgcagtgcacggccacgatgcctatgatcagcaggctgatgggacccatctggggacagatattgcaggcaaaagagagagagaaaagtaggtagaattaggagtgaacccaatggatactcagttcacaaaggattaaaaagctactaaggcagttttcagtgacaaaactttgggcccagcattagagagagaaacgtgatcatggagattagctctgtgagatgggtgttatctgaactttagcacattttcgagagatttagtcacgtggagaagaaggacataagataagtctgttccaagactggtgcacatcagcagaatagaaggctcctgtgactgtgggaagagctgggctaagggatgtgaggtgagacgggtaagttatctttacagcaatgccagatcaagaaagactgcacttagctaagggcaacccacatctctgagtctctcttcaactccgaaagaaaccagaatggctttgggcaggcagtcaactggaggtaaatcacaaaaagaagacataagattcttgcagttggccatttaggaacagggcatgggagactgtagaaaatgggcagacatctgtaactaactcattagttcatattattgacagaaactgctcgagccatctcagtacatcctctccaccatgaagtaagctccatgagggcaggaatatttaattcactgatgtattctaagagcttagaacagtgcctaacgcacagaacactctcaataaatatctttaagtgaatgaatgtctgaattccgctttttgtcaactgatttttttaaaatgcttctctatttaaaatgttttaaagcaagtacattttaacaacaacaaaaagctacctcctaaaatttgtcaccactcctctccactgatgcagacccttaccacgatgcctgcatttttcaccgccagagggagtcccaggagtcctgtgccaatgttgccttttaacaggtggatcaaggtctggaaccatctgaagtggaagacagccaaggaaatgataaccatgacagttaacttttattaggatctcagtgcttatatgcattatcttattttatttccacaacaaccctgtaagattttatcttatagatgatgaagcagtttgctcaaggtcacatacctagtaaagggctggggcaggattcaaatttgggcagtctgactccagagctccccctcttatccactgtgctgtaagtctccactctctgacatttctgagaatcccttctctcagagattagaccagaggggtgctccaactctcttcagacactctatcctttccaagtgtatttgggtctggttctaaccactgaactgaccactgtaaaggctcagacctggccaggcacagtggctcatgcctataatcccactactttgggaggccgaagcggtggatcacctgaggtcaggagttcgagaccagcctgtgccaacaaggcgaaaccccgtctctactaaaaatacagaaattagccaggcatagcggcatgtgcctgtaatcccagcttctcaggaggttaaggtaggagaattgcttgaacccgggagccagaggttgcagtgagttaagatcgtgccactgtactccagcctaggcaatagagggagactccatctcaaaaaaaaaaaaagactcagatcccaaaactgcaacagaggatgacaaaccaaacaatgacggacaaacactggtaagagaacagaggaaattaaaaaataataataataataacagaagccccaaaccctgtaacagaaagatacaaagtgaacagcataaaagtcacaccacaccataagaggccagaagtccctgatacatttagtatttaaaaaaaaaaaaaagtcaggccaggtgcagtggctcatgcctgtaatcccagcactttgggaggccaaggcgggcagatcatgaggtcaagagattgagactatcctggccaacatggtgaaaccccgtctctactaaaaatataaaaattagctgggcgtggtggcaggcacctgtaatcccagctactcgggaggctgaggcagaagaatcgcttgaatccgggaggcagaggttgcagtgagccaagattgtgccactgcactccagcctgggtgacagagcaagactgtctcaaaaaaaaaagaaaaaaaaaatccattggtgatcttgctctttcaatggatcttttacccatgcagaattcctaacatcatactttggttgagtttacacagatcttccaatgttaacatcttcattgtatattaataatatcaaaagtcatatttgttaatatcaccctaatctcatcagaaaagtcttcaagtagaggggctatcaagctcatggtactggatacagttggttttttttcctaattttgcttgaaagcttgaattttattctgggcacagatatgtattatctattgttttccttgaggtgatgggctgatttctttcattttcaagaaaatgtcttacaagtactcaggtctgaatgacctacagtttgttagttgttctttctagttctatgaaaaaaaaaaaaggcagcaagtttggttgacaactcatataatcactcgaggtctttgccttaagacaagtaacatattttggtactcatagaagtacttcatgcatacttcccattttgccacacagaatattaaagacctatactgaagggtctcaaatttttaaatattagtaatcctacagtttcatcaaagacattattaagtgcaaagggcttttttctttgcgcatgtgtggcagtgaaaaatacaacgacaactagtataatttggtgccactgccttgattcgttctacagtgtaattttacccaccattgcttctacattataagtgcaaatatccacaagtgaaaaagcagataacatcttagtattattatgaagagagttttagcctcatagacttcttgaaatggtcttgggaagcccacaaagtgtgcagaccacattttgcaaatgactactccagctcacctttagagagccagtttcagtctgctggtttcagtttgcatggggaagaagcacggaggcttgatatatataatggaactcagaggggcaacaagaagaaaaatctgcccaacagcataaaatgaggctgtcttcgaagcagtcaatagcttggtaacatcaagtgttagtaaataacctcactgaacacactaagaaataattcacaggtcaggcatggtgctcatgcctataatccaagcactttgggaggccgaggcaggcggatcacttgagcccaggtgtttaagactaagtgggcaacatagcaaaaccctatctctacaaaaaaaaaaaaaaaaatacaataagtagccaggagcatgcctgtagtctcagctacttaggaaactaaggtgggaggatcacttgagcccaggagatggaggtgcagtgagccatgattgtgccagtgcactccagcctggacaacagagcaagaccctgtctcaaaaaaataaaaggaagtaacccatgaaactcatggaagtgtttggggttcctatttgcaccccctaactaggggtttttgctgagcccttgacttctagaagagccaggtgtgtgcatgcatatgtgcagtaggtgtagaagtacttccatgtattttgttccttggcaaactagataaaagggtggggcaaaccagaaatataaaaggaacccagctcaaaaacttgtctctaacacttccgacatattaaaatattaatttaggttaagaaggtcctccaaatcaacctctaccttaatcatacctggcatgttttctatataaatccttgcgtggatcctatgccccaggctggaagtactcaaccagtcctctaagattctgtttctgtagcttatttctcaggggatatgcttttgtagattccccattagcctgcagtgggagttagctggtggtagattgcttagagcagcagctggcagcagtgtggatcaccctgcccctctttcctccaaccttatcagcattggcagcccccatgcagaagcatctccacacacagccaatggcatgtgatggcttcccttcagaggtcatgcttgttatcgtaagatacttctaagcttccttctctgtagtttcctttgcagtttttgctcctttttgatctcagatatcaacttgtctaagcaatatttagcagatgaggtctggatttttatgtttatagagacatctctgaagctcaaaacctaccaactagcaggaagcttagaagtatcttacgataacaagcatgacctctgaagggaagccatcacatgccattggctgtgtgtggagatgcttctgcatgggggctgccaatgctgataaggttggaggaaagaggggcagggtgatccacactgctgccagctgtgctctaagcaatctaccaccagctaactcccactgcaggctaatggggaatctacaaaagcatacccctgagaaataagctacagaaacagaatcttagaggactggttgagtacttccagcctgaggcatagaaatcagctagtggtggtgacgggccaggaatgtggacagacattcttctagttccaccccagttcgcaagagaaaatgccctgtaccagcagacagtgcaggcagagggagcttctccagtgatgagcccagaagctttcatggtcccgcttgggccagtcatcaggaatggcataagtctaggacatgaagatctctcagtaagtcacactcagtccacaagaaaacacagaaaagtaatagctaagcttgaggaataacaggactggaaaagctgagatgctggacacaaaaaaaagcagagtctgctgaatcagagtactgggaactactcatggagtacaacttctctgaattttaattagtgggagcccacagccgatacttgggtgagctcattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctttgagccgctctaaagagtacaatgctagtcattatcatagataaactatgataatgctgtaaatacattatcctagtttatccttcttatgagataggtactatcaagtcacccatcctacaaaaaatataactgaggctcaaagaggtgaagtaacttgcccaaggtcatacagcagcagataaggcctgagcagaatctgaatacctatctgtgtctatagcctgtgtttttctttgctggcctatggtgcctcccagtgcatggaagtggaagtacgggaccaatgcaattgatggtgatgatgccagtcattactaagctcctgtctaggcaggacgtgtgcctgggtctgagaatacagaggtcaggaagccattctctctcatctctccctaggcaatcacatccatgctcttggctttgagggccatctaccaatcctctgagctgccaactccaattcccagctacccactggacacctctgcttggatgtctcacaaacaactgggaaataatgtgcaaaacagagcttcggtttagcccataaacctgtcctgccttcccgtctgggcctttccagtctcataaatgcactaccaccgaagtcttcatgggagccaacaatttagaaatcacccctgaatcgtctctgttctttctaactgcacatccactccaccaactcctatcaatttacatacaaaatatgtccgaaatctctccgcttcctgcatcttctccatcactccgtggtctcagccccactatctccagcttggatgacttctcactggtctccctcacccactctatagagcttgaaaaatgagcttcctgagacacaaagaggatcccttttccgtctgaaaccctccaaccacctctcattgtacttagattagaatctaaaagtgttaccaaggcttatacttagaagattggatgccctggtttgtcaaggacagtcttgatttttacctgttgtaaatcagctactaccaagtattatttttagtgcctgttttggactctatgtttgtgtcccctcaaaattcatatgttaaaatctaatccccagtgtaacagtatttggaggtggagcccttgtgaatgggattagggcccttatgagaagggccatgtgatacaatgagaagccgacagtctgccattcagaagagggcactcaccagaacctggccatgctggcaccccgatctgggacttccagcctccagaactgtgggaaatacatttctgtcctttaagccacccagcctatggtgttctgttgtagcagcccaaatggactaagtcagtgcttctctcactctcaaagatcacagtttggacctcagataatacagtcatccaagccacaaggcccacatgatctacccagcctatctcctcagcctcattcccacccctgctcatgatgttctcagtacctcagccatacctcaagccacttcaggctctttcccaactcatgttgctcttcctgcctggaagactctcctgcccacttttcacatggttggcagcttggctctctgctcagatgtcacctcctgggggcagcctccctctgaatgtgtgtccccctgtcttatgagtctctcatcactttacttccttatcatcatttgtaaagatgttatttctttctttatctgtttattgtttatctccatgattacaatggaaagcccctggagacaggaatcattccctccttaccctctgctatgttcctagcagcttgcaaatggcctcgcatgtagtagatgctcaataaatacttgtcgagagatggactgactgactgaaagaatgaatacatcattcccagcccataagtttacagaatagtagggtccactggacttgagatttaggaaagagatttggagaaataaagtgagggagagatatcagaccaccatcttggccactgttctttagcaattcctatgaaacccataacaccaccaccagaatcccctacacacatgtgcatacaatatctcacttgagccccaagccagttctctgaggtaggttgttttagctcctgaggttcagagagctgttctggctaagctctaggagctacagccagagggtgttttgcccaggcacagagcagggattaagaatttggagtctggggtcagagtgcttgggtttgaagcaacccacctttgccacttattaccagtattactttaagccagtcacttaaatcccctgtgttcctcagtttcctcatctgtaaagcggggtggtaactatacctgccctgagtgttatgaggctttagtcctgagaaggacctagcccagtgcctgatgcatcctaagtgctttgtacattttttccctaatgacagaagcactggtggggcttttgccagcatctttactgtccccatggtcaccaccagaagcctagcacagctctcacctggatctgaagctgatctttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattagaagggatcatcagtgaaggacagctcaggagggaaaatagttagatttccacctgatctgcttctcttctgattgcattccctctaggtcactaaccaaagcctttcattgaaacaggcaccaggaatgcctatgtgattttagaggcatcctacaaagagcacagatctagaagacaaaggtctggttttcatcctggctctgctactgacctagtgtttgaccgagaatgattctgtctgcctgagccaggagggatggactggactcggtaagtacatagcacacatgtactgctcccctctccttcactccctgcaggcatcactaatcaatcaatggtgcctacccagcctgggcacagtttcagactccttcccttctcagtgctgaggagctagcaaagatccaaggatcatccagcaaggttcagctcacgtatatcttcctccctgaacccagaccctcctcagccacagtgctagacatgcacgtggctccaaggcctaacatggctccacaaatcaccacaaatggattcaccaccattacttacctccaggatgtgttcatccttgttctctctgtccagctgctgggctgtagataggagacctgagagagagatgataagggagagacatgagcagaagactttcagggccactttactgaggcaacttcaagaattacattcaaatctcagataagaattcttctgatctttgaagaacatgtaaagaccatccctgacttaggatagttcaacttaaatttcctactttatcatggtgtggaagtgatacacattcagtacaaaccatacttcaagtacccatacattctgttttttactttcacttcagtattcaaatactgaagtattgagtacaaatactgaagtgttgaaatattcaatactttattttaaaataggctttatgtgagatgattttgccccctgtaggctaatgcaagtgttctgagcgcatacgaggtaggcaaggctaaggtatcatgttctgtaggttcggtgtttaaacacagtttagacttacagcattttcaacttatgatggatctattggaatatgacctcactgtaggctgaggagcatcagaacactaaggggaaatgaaactcgggggaaagcaagggggaagtgaggagctgggagagaacagcagagataatgtgtcaggtgaagttcccagctacttcctgctttctctattaggcaggggtgatacatcaaaacttcagcaatcggcccaccacgagcagcctcccgtcaggatggttgccagctggaagcaaccagtagggttactggtgcacaagggtcaatgtcagcactgctgtgatgcagttttggttcctcgtcactaaaatctatggaacatgtttgcatctggatgtcttctgctcatcattcattccctcttctttcaataaacaaaccccagttctcctgaggggaaaccaggagaattaggttctaattaggaattagaaccattcctagctttagtccttcattatctggggtgaggctgacccgcctggggagaagtttatagcccaaggatagccagtcagcacagactatccccctggcccttgcaactggctctgcaatagacaagggacccgtctgtctgatgagaatccattctgggacttttgcaagagctctagaaagagacttttttctgctgctgtgctgagagaacagaaggaagcctgacagcaacaagaagagggactcctgaggctagacccactcagagaaaatgaggccaagagataagcagaggcagcgccttcattacattattccaacactggctacagctgtgcctgcagccatactatgtttggaattttctgtaaagtaagaaaacaaatgtcttttattgcctcagccaacctgcattgggtttctatctttacatctgaaaaagtcctgacaaccaattcaattctgagaattcatatgttgggataggaatgggttacgggtcatggtgaggctgggaaagcattcagggtctttgggattgggaggcctccaggaaggacgctacctcctgcctcagcctctcccttcccctcctatggccctgccaacccccagctccagcctcaggttccttacaggggacccactaatcccctctgtgcctcgccttgactccaggaagctcctgcttatttctcccaaccttatttcaaccccagcctcctctgcaaaaggagttgaattcggtgacctttaacatctttctggcttaagttctgaacttctcatgccactttaaggaatgtattctaaggaaatcagtgcatacatctgggaagatgagttcacacggtgttcacctgagtcacgttttaaaaagccaataattggacacaatccatataagggaagagttgtatacattttacataaaaaggaatcttaagcaactattcaaaatacattctgtaaatggggaaatgctgcacacaatatattgttgaagtaaaaaagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttattggaatccctggcctgtgctctaaagagaaggcttacctgccaagaccccctagtccttgtgctcttcctgggggaccccaggccctaggcccttccccatgaggcccctcagcttggggccaagctgggacagtatccagaccctcctgtcctacaggagtgtgtctttccttccacttgtcctccttctttgactggaagggcgcctgagtgtggagcttctcaggagccttctccaatcccttgcacgccaaacttcagttagggaagaaaaagccggaatgacttgcgttcaactgcacaaggcgagaacacgcccccgacagagcccacatcctcacaccacactcccattgccatgactggaggctctggcccagaactgaatccctgttcccctcgctgagctcccagctctgtcactgagccccccagggaaactctgggctcttcactgagcttctttttctacacttaattccattatctcaatcacttcatcacctaaacaagatcaagaaagtgaaagtgttcagatgttccattaacctcgaccagtagctctgctttcatttacaagagaccgtccacaccagccacggcctcttaggccatggctttggatgaccttctgggcccctgaaaacctccacctcaacttccctgaatcttgcagagagctagcgccttctctacccaacttcttcaattacggatgaactgagaggagcccagaggagccccctctctatttatctgcaccagcctgtcatgggaagagccagtactaggaccctagtgaataataataataataaatggggaaaatgctgtcacttcatggtttctctgaaacggaaggcaatagttgttatttctgctgtagctcctgacaagctgcttttttttttttaaaggagtctcgctctgttgcccaggctggagtgcagtggtgagatcttggctcactgcaacctctgcctcctgggttcaagcaattctcctgtctcctagtagctgggactacaggcacacgccacaacatccagctaattttttttgtatttttagtagagatgaagtttcaccatattggtcaggctggtctcgaactccttacctcaggtgatccgcccgcttcggcctcccaaagtgctggcattacaggtgtgagccaccgtgcccaggcgacaagctgccttctttagaggacagtagcaatggttctcatggacaataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagtaaaataaagaaaaattatcatctgagttcaaagtgaatgccatgaaaaatagataatgccattttcagagagcatcttagatcggttctcaaaagtgtgcctaaggacagagtttcctgagctgcatttcgaaggctggggagtactgagggagcaagaggacaggtctactatctctccatagttatttctacttctttttgttgtgtacagagctgtgaaaatgataatggccatagtacaatagcagagagaatcaagttcgtgttgataaacttttggctgttgcatgtatcattccctgcagcccctgcacccctcacacccagacttcctacttaacagtcctctaccctgtacctaaatgtggcacaccctgccttttggtctcagtttaggcatcagtttagctgggaagccttttctgatgcaccaacactggttggttaagtaccatctccttatgttttccgttgtacctaagccatcccctgaccttattacttattattcagtattgtattgcttcagacttggtgtctctgtcattaaatggaaagccgctagaagcctgtgctctttattttcctttgaattccagtctagcaccatgtctgatacatgacaggtacttaaaaaatatcacttgaatgaacttcagtacccagcccgtgaatgtaacctggggttactggggtattggaagttataaccgtaagggttccaatgtgagtctattgtcttgagaagatccagttctctactagttttcacttacggactggagcttggattatatgtaatccaagtagtacccagcagtttaaacttccaacttattatgagagcttattagagcaagctgtctgtgcctgtctgagactctcattaagccattccatgaaatatctgcatgaatctgggcatcttgcatctgagagcccatttccggcggttagtgcagttagaactgaaaccagaggctgaaaatgagtcggcacttgctcactagcatttaggtcactttcaatttaatctgaaataaaattctgttcctttacttcttttttaaaaattaggatactcaagctattttcatgttaactatatattttctaagttgttagtgggaatagccaaccagtcactttctcttgtggagtgaaagaaactcttgccctgtgagattagagtgaggtgttaaggaaaagatgtcagatagtttgaattcagaccttctccgagctgtctctccaaatgtggtacttgaattcaggataactggtcaaattctgcactaaacataaggaatgaattctgcctccagtctagacaaagtcagtgtacccttgtagttatcagggatgagagctggcttatatgctgtagactgtgtaactcactgggatacatttaaaaatggatgcattgaagtggttaaatatgacaaatgaagaaaggaaaggaagtcacggtaatgtctgaattcaacccaggtttctgtgtcctacttgttcttatacctatttgtctgtaaacatgtggatttttttcctgaatagaccatgttgatgtatggtattcacattgtgaggtccatgtattagtggcattttaggaaaatatagcccgaagtggggaagctatcacttgaaaacatgtcatcatgcttggacatagccaggaaattaaccatgtcagcatgataatatttcttgaaaagcctgaaacccatttttctatgctgatagttatcagtttctgctataaactcacttgtattatgataagatatcttcaaagtttttttttttcttttttttttgttctaatcctaagaaaacagagctggtgtctgcctgactgccccactgggagataagttgttgaatgaggtgtagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcaaccccagagagggtggaggagggagaaataagggtttggtggggaggaggctgtaggaaggaatggagagaaagagaagacccccactttgaatcacccgagttgcattcttttttcctttgttctttgtagctgtgacttgaagctccaccaatatccctatgtccccacgagccccaggaaagctggccccagcctgcagacctcattgattttgttgtccagcttcatcacttcccctggtttcattagtttcttttgaaaggcactccggacccgctgccagtcttccccttccctgtgagagaagcaggaatacatttagagcacactgaaaagaaaagaaggagatgcagaaatactccagctgcaacttcaggaaccataaaatcaaacaaacaccgagaatcatgccaagaaatagccagagaatattagcatcagaatatttgggataaaatagtgatcatcttttgacaatagtttgacaataggatgaaaaagcacctttcctcctagtcaaagattgcaccaaaaagttgaagtccagataatttgggttcagggattttgaggtgtccttgcagggagtggggctgggaggcctggggacaattcctagcggtaaaagggggcatgtgaacaccccatcaccagcaactcagatctgtttgagggaagaatcttgtcttctttcaactcattggtgtgggcttcatatttacaaaatatctcagatttagaattttgccatcgcctccaaataataacatacagtcagagagtcactggagtaataaaaagccttttgcgatcgtgcacttgtaggcacctgccccatagcagaccatacagcctgtgaagcaccgtgaatttaataggtttttaattccagtcattatatactggaaaatataacgattacgcattacagtttgggggtaaataaaagtgctaacttgttaaatgcttacaactaaaaagcagaagaatcacattccatagtagcatttatcgacctaaaacacaactttgatattccttcttattcaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctgatcgcttcactgactgtctcgtccattggccctcaaaccccatctatctgccttggcctcccaatgtgctgggattacaggcttgagccaccgcacccaacctttttttctcttatagtctttccctcagagagttcctctgttcacatctcacatctcatcatgctggatattcccaaatctatattcccaaatacttccaggcccatattttaaactgattttataaacacaacatggcaaacccacactaaccccttccctttcaaatcaaatctctttcttttatttttccatatgcgcaatgtcatctggattacttcacacagcaagttctaaatcctcgtcttctctgcctccttcacttcctcagtcaatgtattatcaagatctgttgattcttatttcacaacatctcacaaacttgacttttcctcccatcccaaatctatcatccctccaagaagttcaactaccaatggtctcttcctttactaaatttgacctgtacccattgatgtagccaatgattcatgactttaataagtatttattatatattttattgatgaaatgccttatgggaggtgctgtaaatattataaagagcactaataggaagtccttctgcttaaattctgtataatgtagttaataccacaaatatatagaactttattatatacatatattctctctgcagcttaaagtttcataataatatataactccattgactaatcaggtaattatgttttaattaccctgcttgtaacactaccaatggaggtagggataagcccttaccaaaaataatactgagtgagaaaccagcatgtccccagaataataccactgctgtgcttgagaggctttgggctttatgcatcctaacagtggggaacaaaggtgattagaatgtgtgctctgtggtttgctaatcatggtgctgaagatcaagagtttgatataattgtacttaggggtttagggccaatgacgaaacgtcgtgaagtctaaaagcatacctctctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaaagagccccgacaacacgataattttagcctggaagagcctcatcagacttctgacctatagaactgtaagataatagatgtgtgtcgtgtaactcactaagttttagtaatttgcggtggcagcaatagaaagctaggacatcagctcactcattagtttacaaattgcctgtggctgctttcatgttccaaggtagtattaagaggatgtgacaaagactgtatggtccataaaacctaaaatatttgccaactggccctttacggaaaaagtttgccaacccttactattcacatgcaaaaaccatgaacagctgctagcatttactgaacacttaattgatgccaggctcaggaataactacttggtattcatattaaatttttgtgatacactctctttgggtcatcattttacaaatgaaaaaaaaaaaggaagtagagagtttagggaactgctcaaggtcacccagcaagttagaggtgagctgggattcaaaccccagtctggctgacttcccagcatagctcatccctcgtcattctcactaccttgcagaggataatgaaccgcctagatgctcacctgaagcgtattatcgctggcaaaacgcgatggggagttcccggctgggcaccagggtgcctgagtgtagcatctcaacaggctcattgtctgtggcctggatgtcgtatttgcggacaatctgtaatgcacacgcacacaaaaacagaattacccctctcttcttctgccttgtgaaacagcacagaacataattgcagaaaccggtaaaggttttacccaacaaagagccaaatgcagttgaagctctgctaatcggcgaccaatgcacattctttttccaacgccaaatggaagatgcgcaaaaggattaattttttccttctcctgaagccaacgttcaagtcttaactgacttgaatcttcaaaattggcttcactggatccaacacctgggtatttagcatgagcactgtctaaacacatgcgaagacccatagtatttaaaataaccagaagaaacctttggaatggcaaattgacgcgaggtgtccacttacaaatcaaaagactaattcacaaatttattatgatgattggtggccaccatgcgctagtgcttaaaatggtgccaggcattaatatgttaagggctttaaattgtgccccatactcacagacagcctgtgccagagaatcttgtattaaacccctttacagaccgaactgagctctcagagagtatgggactgatctaggacacccaggtctaggatggaatggagccgtgtcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaggtgcactcgagatctagagattcagatggccacaaactatctgtcatttaatttagaaacaggggtgaaagaattaagaaaaaaaaagggtagcctcaaaattgggggttggaagaacctaagaccccttttaaatacgtaccgggggttgggaaaaaatttaaccaaacagttaaggaaccctttaaatgtggagggatttatattggcagataaacaataagccaagattaaagaaactatgaccttcaataaattttcaagacccagaaaatgaccataaacaagtagcctttgaaggtagtacagccccaaaaagtaaatgtggttttctaactttatctcagtttggtttttggtagaaatgcaagagcctatcagagggcacagccagaaacgaccaagaacaactgacaagggcattattttcaataacagaatcagagtcttatcaaaagctatatgccactgccagcccagggtgtctctacccttccaagtaagcaatttttatcagtgctatgtgccaatgacatctatatgtatctcattacacttttttttaatgagagtttaaattatgattatcctgttcatattcctctactgtataaaaatcatgggggaggggtgaggagttgataagtctccataaagagctacttttagaaaccttgaactttctggtggttgcaatgactggataagactttacttggtctcctttgaggggcagggtatatcccacatgtggacaaaagggtgtgcacagttttttattggtcacggggcctaattgtctacaaaactcatactacaaaactataatatagaacatttctgggaattggaagtctaataagggaatctatttctctgtcctttttgcatatggtgttactatatgcctaattctcagcaacaatgaacaaaaatgttgtattccacttttaagccacctttaaagaatcacaatattttattcttctcaccactttgatgcaaatgaacagggcaaatttgagccatgtattgaaaatggaatagccagaaatgaaaggagactgggtatcttcatcactgtctgaaggcaacggcctgtggattatggacaatcatggtgatgttatgcaattgagaaacagacttttttcctctacaaattattacacaaagggggtattttgttgtttcagctcgggatcacccctatgtaaaacattctgtaataaaaagcaccagtgcaaaatttacctgcatttaggtatggaaataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattctccttcctttcccgtgggttttccggggttcctttcaagaatcagactttcaacccctttatatgtaggcccggtgatccatgggggaaggtgataaaacgatgaagggtgtaaatgatgaacatgcccaacctgtcatcgcttaatgggttcccattcttgccccatatacaggaagcccaaagggattaagcttgttcttaacatttaccaagcactggctacattcagggtgtttatatacaatctttccccgagacatcctgtaagctggttatgattattggcccattgaatagatcgggaaacctaagttttggaaatttcaaggagcttgactaagatgatgccaagcttttagataggatattaaagcccaggcccacctatcagagtgcaagctttcagacacgaggcttgggtgcttctcagagtatttcatgcttaacagcacagactcacataaatagacttccacaatatagtatagatacatggaggctaaggccatgaactgaaatttagtgtttccccaggttgaagtaagtcaattgtgttgtagaaaaaaaaaaaaaagatcatccctacttatttaaatccccaaacaccatctttaaaacttgagcctatgaagaaaaagaataaagacttttgaaatctcttatgctatccatgatggcatttttgtaaatccattcctgtttcactaaacaaaagtagaaaaaaatcatgaaaacccccaacacagtccatctggggcgtctcagtaagaatcgtgctcacccactccacagcatctttgaggatgtggccttaagtcagacgctgctcatctgttcctgataaatctcttgtaggctccaggactcttcctggcatcaaaaaatatggaacgcatgcaacgacactgtcctcttatttattttagcaaatgaaaatctgccctcacaggtttatggtcaagatgtctaaaagatgtcttggatttgtatttaaagagcaccttaacagtaagtgactcctaaatgagctcttccacataataagatagaatagtgatcatgaaacttaaagtatcctatttgagagagaggatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgggcagtcatcaggaatggcataagtctaggacatgaaggatctctcagtaagtcacactcagtccacaagaaaacacagaaaaggtaatagctaagcttgaggaataaacaggactgcaaaagctgagatgctgggacacagagaaaagtcagaggtctgctgaaatcaggagtagctgggaaactaactcaatggagtagcaaaacttcctctgaattttctaattcaagtggtgagccccacacagccagcatagctttgtggtggagtcctcaatttttctttacatttggggaaagtgagacctgaagcgggccaaactcagcccaaatgagtctggggtcccagtttctggagacaagagattaagccctctttggagaatgcaaagtctatctttcctttcctaccaaccctgaattttttaagtgcagaagttaattcttctctcttcccacttcttcagtcaaatgaatactgatttggtgatggggcagaattcggggggagactttgcaaaggaagcttccgattatgcttggaaattatttggggttctagcacagatgacacacttttaaattaaaagaatgtcctctgtagaagctttttttaagtccaagctctcacttggcaccagccttggggggccaacacagctgaaaggaaaaaagagtaagaaactgcctagagagtggcagcccaggaaggcaaatctcagcgcagtcactcgcccaatctcttcactgctgaccttcatctgtaaagtggaggactgatgaaattggggggaaaaataagtccaagggaggcttaggaacacgaatcccacccaggagaggagaaggtaacagctactcacgttgtgctattgctttgaccaaagcgctggtaggagcccggggaggagaggttgttgaggccttccgacgggctctcctcagggctcacgtccgtggagctgtagtcgtggtagtcttcattccgaagtctctgcgtggacatggcagctggggggacagggccagcattaagacctcctgcagctggagcctttagctccatatttggggtggcctctggggtagaagctgtcattgtcagagttgctcactgtgacagctccactatggattaagtatgaaagtgcctggtaccaagggaaatggaaaagtgcaaagtacacagaggcgggctgagttcacttgacttctgactcccatccttcccattggtatacgtggtgctacactcataaatttcttaattttccggagtacagctagacaaggcagaagtgaggcaactgctctgcggaggatgggggaaaatgaaagagcaagtgcttcctggaattccgcattgccctattccttaggtcaggattatctactcctttctgagataatgtcttggaaccttgtgcaatagcttcaatcgtgctgctgtatatatatatatataaatcatcccatatatatatatatatatatacgtatatacacggtgtatgttactatattatacacgtatacaatatacacacgtatatctatatatgtacaagctcttggggggatggaaatctgggtatttctcatcgtatactctttttcctctgccttcaatagagaacacatttcactcaagaaatcctctctgggctgggtgtggtggctcacgcctgcaaccccagcactttgggaggccaaggcgggcggatcacctgaggtccggagttcaagaccagcctgagtaacatggagaaaccccgtctctactaaaaatacaaaattagccgggcgtggtggtgcatgcctgtaatcccagctactcgggaggctgaggcaggagaatcgcttgaaaccgggaggcggaggttgtggtgagccgagatcgtgccattgcactccagcctgggcgacaagagcgaaactccatctcaaaaaaaaaaacaaacaaacaacaaaaaaaaagaaaacagaaatcccctctggatcatccaattctgctgaaactcccaccaaatcccagagccacacatgccgttctctttctctctgctgtgaccacaggctgatcctatactctctggaggccaccagtaactcttataccctgaccctggggactcctttcttgctgccaacctgagtactgagaaatggtagctgaaagcagctcagaggaggaccaggaaactgaaaggtgctcaccctggccctcgtctcaacatctccatccacaactcttcttcctttttatttttatagatgtgctcatttttaaaatggtgagagaaaaaaatgtcctttcaatgtgttgggagggtggtgagagtggtgtcccctgggtggatttactcaggaatactattaatactacacaaaagagaagagcaagggcttcttaaagatacacaataaggacacattttgggagcgatgtaggcccctagaatcctagagaccattgctaaatgagccttcacaggtcactctaagccccttactttaaagatgaagaatcaatgctaaaagatgaagtaacctgccctgcaacagctaggtagtaccaagcagaaaacgttatctcctgacccctgtcagaatctgaaaacaaccactctacagagtcccagttgctatgagagagtattacagcacagtgaaagagtcaacttcctgctcttcaagaaccaagtgacaaaaaaagggtacattaatataaaaaatgacaaaaatcctcccgacacttggcagactggcacagctacttgcccgtcagactgtcctccggcatgtggctggatgcccaccttaagcctgggcactctatctcagctaccttgagaggagacaggacctccaactgctgccacagcaccccaccctgccccgacacccagcaccacctgccagaggatggtgctccgccgaaggctctccttaggtccagtgccagggtactcctttggaaacaccccagtctggcaccagagagatccacgggagatcgcattttctctcaacaattgcaatgtaggaaaggacccccaagctatctcacaagggaagtacctggcaaaatgccagcaaaggacctggaaatcccagagacgatcctgcctagcttcattgccagagccacttggctaaaaatctatgagagcttcatttactcatgagctagaggaattcaaggacgccaaccagctctggggcaattaaactcactagagggccgggagaaaaaaaaaatctctgaagtatcttaataccagcattgtaacctcttgctatacaggtataagctcgtaaatcagtttacaggtatgtcaggaggcccaggcgccaagcctacctctgtcaacagtttgcttagtacctgtgaaccattttcaaatgtgcaaaaagcatggggcataaactaaaatatctctcaactccctctagcactaatattctaggtgtcaatgaacataattatttatgcaaacagcagctgagtgcagtgtctcacacctgtaatcccagcatttggggaggctgaggtgggaggatcacttgggcccaggagttcaagaccagcctgggcaccatagtgagaccctgcctctactgaaaaaaagaaaaagctgccaatttctagtcccttccaacaaaccaaaagcatctgaagatagaaccttccaagtgaatcttgtgagaaagaaaagaaactttttatctgaggaatccctttaaattacgggtccagagaggcactaaaatgtgagagcagtcatgtgtcactccccccttgagttaaataattacctcttgaagccacttgctatgtgggttctagactaactgacaccactaagtcataaaatgctaacactggacatcataactcataccctatagtccaacaatgtacagcccatcaataatccatgctatttctgtaaactgatgagaattcctgtcaagtcactttgtatcagtcctctccttgttcgcttttgcctttaagaatctgtggtaacaaaggccgaaggacgcactcccccaggcaacttggaagtgtgtcccgggcagctgtcctcacttggttcaagtaaacagttcaagtaaactgttaaaaattgcattttgtgtctcaacttcttcctttaggttgacacctatatattactgaaggtgaaaggatggaatacagggacttattaattgcccaatccttccctagcaaccgagaaacctctctgttgtctacttggtacagatgttcaatttatctcaaacactgcagagagacttctttatgttgtgtataaaaactgaagttacccacagcagaatattgctaagaaaacttctcaacaagaagctgaaatctatagatttaaggtccaataagcctgcgggatatggaagatgtggctaagcaactgcatgcatattgaaaacagaaaaaaaaaattctgcttgggagttctggttgatgataagctcaacagaaggcaataatataatccaagatgccaaataaaccaacacaattctaggttgcattaggacatgagagaatcatgggtagacatcggctccatccatcccacatgctagtaagtggacctcggctccatccactctacaggccagtaagtggacatctgctccatccactctacatgctagatgttacacatgggtacatgttacacaactcagaattgccagataatgtgttctcttccaggcagcatgctataaaggggataatgacaaattgtggtatatccaggggtcagaactaggatcaagaggggtaggaaaccaactaaatgaggaatggttgaaagcactgagaaggttccacctagcaacttgaggggtacaaaaactgtctttaaaagccgtctctactaaaaatacaaaaaattagccgggcgtggtagcgggcgcctgtagtcccagctactcgggaggctgaggcaggagaatggtgtgaacccgggaggcggagcttgcagtgagccgagatcgcgccactgcactccagctctgggcgacagagcgagactccgtctcaaaaaaaaaaaaaaaaaaaagctgtcacatggattagacttgttatttggggcctcaaaggtcaggcagggctaggatcagtacgtggagagtcaagagggctgattttttgctaggtgtaaggaagaactttctatcaaagacagatctgttccaaatagaacagatcactctgggagaaagcctgttcccttatccctgaaaaaatccaagcaaaagccctttctcagagcagttatgtaaggattcaagcatcagacagtgggcagagccactccccggagttctttctatggctctttttggaaaccaaggcctcctcctcctgctctctgtctgtccccatgagtgctggcatccatggccacactgcccttaggctccctttgatgaaatctgatagccaagtctattgctgcaattgccagttcccgccctatgggagattttaatagtacctgttaactgtctaaatgagggttgtactatgtgagagttgaaggcaagcttgtccttcagattactgaggacaataaacagaacacaaagtccaaatctccattagatatttagactcagaagagtgagcaactgagtaaaaaaagtctgcaagtttgatggccaaaaaaaaaaaaaaaaaaaaaaaatttaagtgtacaaaccttaaaacattccttttttttccttatgtaactattgttttagctgtataaatagacaagtgttgctcttcaatctacaaaatatgccatttttagatgggcactaaaaatgagcaggtggaatcactttgtgcaacggatgcaatatggaaaatgtatgtgcaaactgaatttttatttttaaaaataaaataaattttattctatttttaaaaataaaaatttgtaggtgttaaatttttcagaagtgggcaattttaaggggaattctacagtgattttttttttttaaggcaaggccagaaatttttctaataaattcaaatgctaatgttcccattttaacagcatgggattcaggactcaggagaacataatctggctgtcattctaatcccaaagttgttttcttattttgatatagaattgagaaaactgcattagatgatttctaagtacactttcacttctaaagtttcaggattccaatttcaattttttagtgactgggtttgttcaaaataaaggaggattaagatcaatagatggtaacatattctgaagttgtaccatccagtacagtaaccactagccataaatagctatcttacacttgaaatacacttgggtaaaattgaaatgtgcacactagatttcaatgaactggtaacaaaaaaattgtgaaatatcccatgaattaataatctttatactgattatatattgcaatgataatatctgggatatattgggttaaatgaaacatacgtcaaggaaaaaaaaatagatttctgggcccaacttgattccaccttagcattttattttattttattttatttatttattttaatttatttattggagatggagtttcattcttgttgcccaggctggagtgcagtggtgcgatcttggctcgctgcaacctccgcctcccaggttcaagcaattctcctgtcttagcctcccgagtagctgggattacggacatgcgccaccacaactggctaatttttttctatttttagtagagacggggtttcatcatgttggccaggctggtgtcaaactcttgacctcaggtggtccacccaccttggcctcccaaagtgctgggattacaggcatgagtcaccatgcccagcctatgtttttttgttgttgtttttgtctttttgtcttctttttttttttttgagatggtgtctccctctgttgcccaggctggagtgcaatggtgtgatcttggctcactgcaacctccgcctcctgggttcaagcgattctcctgcctcagcctcccgagtggctgggattacaggcgtccatcaccatgcccagataattttttgtgtttttagtagagatggagtttctccgtgttggccaggctggtctcaaactcttgacctcaagggatccacctgtctcagcctctcaaagtgatgggattacaggcaagaggcgttttatttttaactagcttcctaggtaatcttgattataggtagatttatataaagcactacaaaaaatatatgatcttattatgataggtacaccctaggcctcacctcctaccagaattcacgcattggcgccccttgtttgcaagctaaaagtgtcatccgttattctgaaacaattacattggtttggactttggaactcagagcagcggcaaattccccagatgtattttctcctctctgtcgatggaattctaaaaacatgaacaaagacacagactgtgttgctatgtgtggtctacagtgagggaagtaaaatggtttggcttctacataatttgtttttaaaacagcatcagatagaattccatccaacttaccagagcagaacattccataaattgagactttttcctgtaggagtctgatgctagaacagctacagggcagctgctgacctcagcaggttctgcacaaagcagctgctgaacaggcaaacacgcacacttttactcccaaccatgaagatcactaaatgttagggccaggtatagctttagagaaggtcaagctccagcttccttcttaggggtcagaaaaccagggcccacacacaaaggctgactcatccaggccccaggatgagtcaaatcaaagatttgagatgacagtccagcaaaccagcatcccagtccagtattctttctaccacaccttaaattatataccctccttaaaatctccctgcgaacaaagctggccccagagcctggggcaggattaggtctgcagcgggtattctgcataataaaaagcacctgagtttgcagtctggtagtgtgactctgagcaagttaattcatctccctttgccacagtctcctcatctgaaagatgtcattaataacatctacatcacaatattgttatgaagataggaggaaaaaataaataaatgttagatatgttgcctggaacataataaaccctcattaatgatagcaattgtgattattactacagagaagttcaaggacagaaagtgagaaagttcactaaacaaagtctgcagtatgggctccatttaaaactctggattgtgaagccaggtccctaccttggagatggtgatctaagtgacatgaacatctcagtaacccacagacagatttcctaacttcatggaaaaggaaagcacagagtggcttttcctactagagatggtcattaaggactagccctggggccaagcatggtggctcacatctgtaatcccggcactttgggaggccaaggtgggaggactgcttgagctcaggagttcaagaccagcgtggacaaaatagtgagacctcatctccaaaaaaataataataataaaataaaataaataataagtaaaaaaagaactggccctgggtgtcaaggcttccaagagaaatattttgggggataaaagaagagacaaccccaaatgcagcaccgtgtggttcctatttcagcctatttacaatgccccatccatcggcccccatgcccattaagtagaggctacctttatgtgctcatcacagtaaggcctggccaaaggagagaggtacaggattcttccaaggcctgggtggaagtaaacagactcagtgagagcttcttctatgggaaacaagagaaggcctggatggaaataaacggattccatgtgagttcctctatgggaaaaagagaaaagctggcctaggtgtgagtaatgctaatcagtcatgcactttggaagcggttatcagcaccaggccaggaaaagcagaaacagaagactattcactcatctgacctttgaagcgatatcaagcatttaaagaactgagatactcactggaggggaggtggtggtgataaaaagaaagaaaaagcaggagtacttaatatgagaatagttacctgagacaaggttataaatagaaacaagagtaatcacaaaactggacatcagctccatccactctacatgccagtaagtggacatctgctccatccatcccacatgctagtaagtggacatcggctccatccatcccacatgctagttaagtggacaccagttccgtccatcccacatgctagtaagtggacatctgctccatccactctacatgctagtaagtggacatctgctccatccactctacatgctagtaagtggacacctgccccatccatcccacatgctagtaagtggacaccggctccgtccatcccacatgctagtaagtggacaccggctccgtccatcccacatgctagtaagtggacatcagctccatccatccgcacatgctagtaagtggacatcagctccatccatcccacatgctagtaagtggacatctgctccgtccactctacgtggctagtaagcggacatctgctccatccactttacatgctagtaagtggacatcggctccatccatcccacatgctaataagtggacatctgctccatccactctacatgccagtaagtggacatcggctccattcatcccacatgctagtaagcagacatctgctccatccactctacatgccactaagtggacacctgctccatccatcccacatgctagtaataagtggacatctgctccatccatcccacatgctagtaagtggacatctgctccatccactctacatgctagtaagtccagtcctagaatgtcacagactcttgagttgaaagaaaacttaaaattttgtctagtccaaccctctacccaacaatctaatttcatctacaacatccccgaagtaattgcccagagacgattacctccagtgacagggagctccgtgctcagtgttctaatacaggagaccactaattctttgaaagtttttaacacttaccaaacacccttcccttatggcactttcatctattggtcccagttgtagtctccagaatattataaaataaatggaatccctttttcttacaccgcctttggaacagagaaaactctgagcacttcgaactgccacaagaggaggctgaatgaacagctacatgccttaaagggaaaacaaggactccagagcaggcgaatataaacgatacaatcagaaaacaaagggagaggcttaaagctgttatcagcacagcctctgctgcacgtagcctccatccccagacaaacacaaagtttgtccctttccacttgacttcaagaacatttttaacgaaaacatgttctaaatgtacaagtaagttaattactgtaaacgaggctctagacaagagtcagaagagggccctgatcatgtttaaaataataacagacagttaaaaatcattttcagctgttagtatttagcttagacataatacagagataggaagaaagaggaggaggattttatagcaacagaggaataagcagaggaaactgcttcctacacaattagattaagtcttgttgcaaggctgatactcagtgtacacagcgggtaaaatctctcggaataaaaaaacaaacagaccctggtcaggggcactggctcacacccctgtaatcgcaatactttgggaggccaaggtgggaggatcacttgagcccaggagtttgagatcagcctgggcagcatagtgagacctcatctctatttaaaaacaaacaaacaaaaaaacaagcctagaaagatgcacaacatccagatcacagcagaaggggcccttaagaattcaattccatcactgtctagactgagaaacccaaacgcgagtcacttaaggttgccaggtaagcggcagagctaggacaaaatatcctgattccccaatctctgttctgtccattgcaccatgatgctatcttcagcaaaattcaaataactgcaaaacgtccatccaaataagcaatcccaaatctgacaagttacagaaaaaataaagcaaaggtctttacattcttcaagttaacgtcagggctctccacaacctcggctcagccacctatcttcccagaagcacattccgattcatatttcatattttggtgtgacttacatagaatgcaggaaggttagaaaccaaacctacagaaggatgagtttgcagaaaaataatgaacaaacagggaaccacacccagagcaaatccaaccccagcggtggaaaatgcagacagctaaaaagggagaggactaaaagagaaagggacagaaaggagtgccttttcacaggtgaagtttcccgcaggaggcggtgtggcgaaaagcaaacagctgctgaagcttaggaacatttgcattctagtcgcaggtctccgggtctccgattaactcactggatgaccttaggcaagcccttaccccttcccggagtaagggctcagtttctccaactgtcctaggagggagctgcaccagacgacttcccagcgtccttgcagttctgacccaaagacccattatgagcctgtctcaagcagcgctcccgcagcgggcaagacatttgctggaaacggggagacctgtgcgaagcgtgaaagacgccctagatggtcctttgggttatcttcaccatctaccccagtttcccccacctgtcagtcaaacaggacggtgagatcccaaccccacgaggtcaagggagatagcgcgagggacaagggatctccacgcttcgcccaattcacagaggggtgtcagcgtcgtaccgcagctgcggcccggggacgccaaggagtcgcggacccacagcccgggcggatccagtgcctgacctggagcatctgccacgccgggaggaaggcgaggtgggtcctgcccaaggcggcgagcgccgccagccggcagccagtggaggaactcactgctcgggttctggccccagctccggctccggctctggcttcagcacagcccacccttcccgggttcagtatcagcccctcgccatcctcctttgctgcccggcagccgcttccggacctcatcacgtgatcccaccgcccacgccagaggccgaggtcacgtgctcccttgagcggccgcgccttttttctcactgagctccggagctctgctccacagcaccacctggcgacctattactgccactgctggaaggactatgttcctgggcgctggggactgcgaataggaactgaacagggcattgatcttgggcatggggcagagtccagtcgaagagcactgtcccttgagttgtgggtttgtgaaatattgctaatttttacactggctgtattttcttttacacatctcgatgagtttgtattgcttttataataagaaatatgcatatttttaaaacttccaatttttcagaagcatacacaaactatcatctgtggttgctactggaaatggaactgtggggtagggcaacattatcttttaatacattcaaatttttaaagtaacatttttaaatggatggcaacatttcagtattgtattatctaggcttctccttttacctccttgttacagacttttcctttaacaattatgtaacaaataggcttcaagtcaaaaactgtcacaagagacagagaagatcattgtttaataataaaggggtcaattcatcaagaagacacaactgtaaatatatatgcatgcaaaattggagcacctaaatacatacaactaatattaatggccatgaagggagaaatagatagcaacacaatagtaggagggtcaatatcccactttcaacaatggatagagcaactagagagaaaataaggaaataatgaacttgaattgcactttaaaccaaatgaacctaacagatatatacagaactttccattcaacagaaacagaatacacattttttctctaacacacttgaaacattctctagaatagaccatatgctagtccaaaaaacaagccttaaatttaagaagattgaaatcatattaatattctttcagaccataataatatgaagctagaaatcaatgacaggaggaatcttggaaaattcacaaatatgtggaaattaaacaacacgcttttttttttctttgagacaaagttgcgctcttattgccccatctggagtgcagtggtgcaatcttggctcactgcaacctctgcctcctggattcaagcgattctcctgtctcagcctcccaagtagctgggattacaggcacgtgccaccacgcgcgactaattttgtatttttagtagagacgaggttcaccatgttggtcaggctggtctcaaactcctgacctcaggtgatctgcccacctcggcctcccaaagtgctgagattataggtgtgagccaccatacccagtcctatgcttcgaaacaaccagtgggtcaaagatgaaatcaaacgggaaatttaaaaaatattttcagacaattgacaatggaaacataacataccaaagcttatggaatgcagcaaaagtagttctaagagagaagtttatagcaataaatgcctacattaaaagagaagaaagagaccaattaaatagtttaacattatacctcaggaaactggaaaaagaagagctcacaagacccaaagttaaaagaagaaaagaaagagcagaacagaaataaatcaaatagacaacagaaaaaaaaacagacaaaatcaataaaactagagttgattttttggaaaaaattaaattgacgtaccctttgctagtctaagaaaaaaaagaagactaataaaataaaaaatgaaagtgaagacactacaacagaagcttcagaaataaaaagaatcatatggggctattgtgaacaattatttgccaacatattggataacccagatgaaatggagaaatccctagaaaaatacaacctaccaagattgaaatcaggaagaaatggaaagcctgaacagactaataacaaataaagagattgaagatgagacagggactatctgactttctggttttctgtttaaacttcccaacaagaccagatggcttcacagctgacttctaccaaacattcaaagaagaaggtttgttactaaactcttccaaaaaatggagctagagggaatacttccaaacacattttatgaggccagcatcaccttgatacctaagccagagaaagacgccacaagaaaagaaaattacaggctgatttcgctaatgcacattggtacaaaatcctcaataaaatatttgcaaacagaattcaacaacaatcaaaaaaattatgtatcatgaccaagtgggatttatccctggcatgcaaggctggtttaacatacactaatcaagcaatataatacatcatattaacaggatgaaaaatgaaaaccacatggttatctcaattggcctggcaaaagcatttgacaaagtccaacatcttttccttccctaacccccaccccaacataccttcttgataaaaaaaaactctcaatagtttaggtatagaaagaacattcctcaacataataaggtcgtttatgaaaaacacacagttaacattttaattaatagggaaaaactgaaagcttttccaccaagatccagtagcagtcaaggatacccaccctcaccacttctattcaacatagtactggaagtactagcaagagcaatcagccaaaaaagcaaaagaaagaaaggcatccaaatcagaaagaaaaaagtaaaattatctttatctgcaggtgacatcatcctatatgtagaaaaccccaaagattaaaaaaatactgttataattcatgaatttagtaaattttcaggacataaaaatcaacatacatgactgggctcagtggctcatgcctgtaatcccagcactttgggaggccagggcagtgggtcacctgaggtcaggagttcaagactagcttggccaacatggtgaaaccctgtctctactaaaaatacaaaagtcagcccagcatggtggtgcatgcctgtagtccaagctacttgagaggctgaggcaggagaattgtttgaacctgggaggcggaggttgcagtgagctgagatcgcgccccttcagcctgggtgacagagtgagactccatctcaaaaaaaaattaaaaaatcaataatatttttatacacaaataattacctacctaaaaaagaaataaagagaatgattttatttgtgatagcattaaaaaatactcaataatcaatttaaccaaggacatgaatagggtgtacactgaaaactataaaacaatgattaaataaattgaagaagacacaaataaatgaaaagatatcccatgcacatggatcagaagaattaacattgtggaaatgtccatactatccaaagcaatatacagattcaatgcaatccctatcaaaatcccaacggcattctttactgagatataagaaacaatcctaaaatttgcatgagaccacaaaagaccctgaatagtcaagacaattctgaaaaagaaaaacaaactggatgcatcacacttcccgattcaaaattatattacaaagatatagtaatccaaacagtatagtactggcacaaaaacagatatgatagaccaatggaacacaatagacagcccagaaataaattcaaacatatatggtcaactaattttaaagaagggcatcaagagaacacaatagggaaaagacagtctcctcaataaacggtgctgagaaaactggtttttatgtgagaaagaatgaaattggatgtttatcttacaccgtacataaaaatcaactcaaagtggataaaaggcctaaatgtaagatctgaaactacaaaactcctagaagagaacataggggaaatgctcctggacactggcccttggcaatgatttttttggatatcagaccaaaagctcagattacaaaagcaaaaataaataaataggactatatcaaactaagaagcttctgcacagcaaaggaagtaatcaacaaagtgtaacggcagcttatgaattggaaaacatatatgcaaaccctatgtctaataagcgcttaatatccaaaatgtatcaaaaactcatataactcagcaatagaaaaacaacccaatttaaaaatgggcaaaggacctgaataaacatttctccaaagaagaaataaaaatgctcagtgagcatatgaaaaagtgttcaacatcattaatcatcagggagatgcaaaccaaaatcattattagatatcacctcatacatgttaggttggatattatcaaaaaagtcaaaagacaacaaatattggtgaggatgtcgagaaaagggaattctagtacactgttggtgggactgtagactggtgcagccattatagaaaacagtgtaaaagtttctttttttaaaaaaaacagtataaaggtttctaaagaaattaaaaatagaactaccatatgacccatcaatcccctttctggacatatactcgaaggaaatgaaatcaccaccccataaagatatctgcatgcccatattcattgtagctttattcacaacagccaagatatagaaacaatccaagtgtctattgacagcagaatgaataaagaaactgtggtatatatacaaacatttttctaaaaaaagaaaggagtcctgccatttgccacaacatggatgaaactagaggacatcatgctaagtgaaataagccagacacagaaagaaaaaatattgcatgctctcatttatatgtggaatcttttttttcaagtcaaatacacagagatagagaatcaaacagtggtgaccagggcccaggagtgctggaggaaggaagtggagaaatgcagctgagaggatacagagtagcagatatgtaggatccataagtctagagctcaaagggacaacataaggactataggttatacattgtactgtacaaacagtagaacagaggttactagtagctgagcagggtggaaggaaaggatagggagagatttgttaaaggatacaaaattacagctagataggaatcagttctatagctctgtaggatgagcataggtaacaataatataggatgtattttcacatagctagaagaggggttttgaatgttctgaacacaaagaaataagcgtttgagatgatggatatgttaattaccctgatgtaatcgctgtacattgtatacatcactgtgtacctcataaatatgtatagttatgtcaattaaaaataactttttaaaaataaaaaaatcacactgtatttaaaattcctgtgaaatgagtaaattttagctgctcttgccacaaaaaagaaaccccaaataatgggtacgctatgtgaaatgatggagatggcaattcacttcactatagttacaattttactatctataagtatcgcataacatcatgttgtaaatgctaaatatacacaaaaacatttatttgaaaaataattttaaaacaaaaattatgttctcaaccaaaaaatactattaatacagctacaaatggatgtcaaaataattatacatggataaatcaaaaaataattatgctaagcaaaagacattaggaaaatatttcatttatataatattctagaaaatacaaaataatataaagtaatggaaaacacacatcagccattgcctgggaatgcggaggagagacaggagagagggtgattataaagcggcatgaggaaattttcaaggggacaaatttgttcaccatcttgattgtgatgatttcacaggtgaatatatatgttgaaacttatcaagttacatgctttaaatacgtgcagtttattgtatgtcaattatacttcaataaaagcattaagatattcagtaaaaaattatataataggttaatatattcttaaaagttagacaatatagaaatatataaattgaaaatcccctttccccaaattcactcccctctccaaaggtttacaggtgccagcatgtgtgtattgttctccaaaccctatattatacaattacagaaatatatacgtatgtatagaaatatacaggtttatggtgtttaaatttaaaatcataaataccagtacttattgttttgcttaagacttttactcttcacaattttctcatttctcccccttctacccacttgtctcctccactttcaatatgtgcagaactgttttttcataggtcttcttagaagctctgatgtatattaacatacattaaatacaacctcttgtttatagcacatactattaaaaactttgccttagagtatgcactccatttctttgccttttgtttcatttttttagaaatgaggtcttgctatgttgcccatattggagtgatcatagcacactacagcctcaaactcctgggctcaagtgatctcccatctcagcctcctgagtagttgggactacaggtgcatgccactgcacatcactagcatgcattctgttttaaccattgtgccagtgcttctcaaagtgtggtccctagaccagcatcacttgggaacttgcagaaatgcaaattctgggtcctactctacacctactgcatcagaaaccctgggttgtgggggcacagcaatctgcattttgaaaagccctctaggagagtctgatgctctctcgtgctgtagaaccactgccctaaaggacaagcttctgaagggacttgctttagccatgtgctaacatgttgtgtggccagcccctggtagtgacttatttctgctgagtggtagaaagtaatttgaaggtttttttccccttatttcccagctgggtgacctgggcaagacttttgatctccatttggtttcatcatcaggaaagtgagattgaaaaccctccttggttctgcctccctccctggattgctggaaaagcagatgagatcaggcgcttaaaggttctatatataacatgaggggctgctgagagatattagggaaattaatccttttgcattccatagtcttgaggaatgtaacttcctttttttttttttaaccactctacccatcccaagccctcaagagtaccagcccctgagatgtcatagcaaccctacccagtgtcccctttccctctccttctctctttttgagaccccttgggtccctgatccatcctcctgaacattctgtgactgatggccctactgtcaagcctctctctgttaagaccactgccccctacagtggcttctaactctaaaattctcaggttttgtatcttaaaaaataaaaaataaagaaaatatgcttacaatgtgccaggaactagtttcttgttgattgagtcaatcctcgtggcagccctatgaggcatttaggagatgctgtaggtgcccttcctgtatctcctttaccagagctgcagccccatccctagctgcggtgagtgttgcctgctacactgtaaagcatgctacactgttacgtagggatacaaaaggcctacctacttttgtcactatacagagagcaatgccgttattcacactcatgaaactcctgtgggtggtctgggtaattcttcgctgtagtataagcattcatcagcattatgatttcaatatttggcaacccaatcacaacaaaattcaagaatttattaagtggcacaagtgctgaaaaatgaatttgaaaattccttaactttggagtggaaattagaaaaaataaaattcctataaagaagaccaaacaccatcagatatgacatgctggtgccttaggagggtgtctcctataaagtaaattagcactggagtggaacagatgaaaaacagccactgaagcaagaaatcatcagctcaagtacataggaaaagtgctggggccagatcaatacaactggaatgtgcctcaggccatgctattgttttaaacatttctttttcttttttttttttcttttcttttttttttgagatggagtctcgctatgtcacccaggctggagtgcagtggcatgatctcagttcactgcaacctccacctcccaggttcaagtgattctcctgccttaggcttccgagtagctgggattataggcacctgcaactgagaggtgacagcgtgctggcagtcctcacagccctcgctcgctctcggctcctcctctgcctgcgctcccactttggcggcacctaaggaggccttcagcccaccgctacactgtgggagcccctttctgggctggccaaggccagagccagctccctcagcttgcagggaggtgtggagggagaggcgcgagccggaacccgggctgcgcccggcacttgcggaccagctggagttccgggtaggcgtgggcttggcgggccccagacaatgaggggcttagcacccgggccagcggctgcggagggtgtactaggtcccccagcagtgccagcccaccggcgctgcactcgatttctcacccggccttagatgccttcccgcggggcagggctcaggacctgcagcccgccatgcctgagcctcccaccccctccatgggatcctgtgctgccggagcctccccgatgagcaccgccccctgctccatggcgcccagtcccatggaccacccaagggctgaggagtgagggcgcatggcacgggactggcaggcagctccacctgcagccccggtgcgggatccaccaggtgaagccagctaggctcctgagtctggtgaggacgtggagaacatttatgtctagctcaaggattgtaaatacaccaatcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttagtagagatgggatttgaccatgttggccagatggtcttgatctcctgacatcatgatctgcccacctggcttcccaaagtgctgggattacgggagtgagccaccatgtccagcctgttttacacatttcttattgtgattttttgatgatttgaaaggaggtaattatgatataatatggtttggctttgtgtccccacccaaatctcatctcgaactgtaatccccatgtgtcaagggaggggcctgggtggcaagtgattggatcattagtggtttcccccatgctgttctagtgatactgagggagttctcagatctgatggtttaaaagtggcagtttcccctgacactctctctctctctctctcctgctgccatgtaagacgtgcctgcttccccttcaccttctgccatgactgtaagtttcctgaggcctcccagccatgtagaactgtgaatcaattcaacctcctttcttcataaatgatccagcctcgggtagtatagcagtgtaagaacaaactaatacagtgttagaacgaactaatacccaataaaacattatatcaatagtatttttgtggtaaatgaaatatgtttaaagaaaaaaaatgtggcaaaggtaatagatgcatgcactctgaggactcagaaaaaaatgttgcaagtaattcaaaattctgtcctgtgattaaacaagactgctctgccaccaatgccaggtctctggtgcctgggagagtgcatgagagatggtgaattttgcagtgacagagacctgcagagcatatgtcaaaggatgccagagaacacctctgcctgacaacctgcaggcaggatcacaatgacaggagtgtcagagcacatgtatgagacccaagtacactcctcttcttggaacaaaatgctgctcacacaggagctcaacaaaagaacaagctttaaacacattatattgctttaacataaggaagactttcccaatcatgtgcagtggccaatggtgtaccatgaatgagttatagggggtgctgagtgccaggtgggtcctaaggtagctagagcacctgagtgtgtttcgtattattggtataatcatctagcttaagaacagacctgtttacttgtgatctcaacggaaatatagaagatgttatttccttcatgttatgtgaaaaagattgggaagcactgggtaagtagggtgtcatataatttatttgttcaagtggagacacttttaagaataaaaaggctgtgttaacatttcaccagaacaacgggcacacagtgaaattgtcccaggtaaagtggaatgtatggtgtggtaggcagagtaacagctcccaaagacgttaattaatctcgggaacttgttaccttagatagcaaaagggactttgctgatgtgatgaagttaaggatctcgaggtgaaatgactatgctggattatctgggtggtcctagtataaatcacaaggttttttaataggagggaggcaggagggtcagagaggagagaagtttctattctactggctttaaagatggaggaagacgccatgagccaaggaaacgcaggaggcctctagaagctggaaaaagcaaggaaacagattctaccctacagcctccagaagaacacagccttgtcacaccttgattttaggacctctgacttctagaactataagagaatacatttgcattgttctaatctactaaattgtggtaatttgttatagcagcaacaggaaatgaatattatttataatctaaaataaatgtagctttatgtttatatcattattaaagttatgaaggtaagcaataaagaactaaaacagtaaaataattatattgagaagtaaagtacgagaatttaagaggtacaaattttcactaatataatgttgatcaattgagaaatatcattatagtatattgtatagagaaatgaagaactaaagaataaaacaaaccactggttttatacacttgatcttagccaaaagataagaagcaatcaaaccactgattaaaaaacagaaagatagtctaaaaagagcagctttagatagagtaagtcagataaggagactatagcttttcattataaattctttggttaaaataaatcatagtttaaacatgagcatttttaaagatgtgaatattaattgttaaagtaagattgtgttaggggacaacttcaagagcttattgggctcaggttctccaaagctgtagcccctttctacctaaattgtgttcatggcttccacccaactcagagcctcccctaaactcttagctcagccagcagcttccttgctgtcagtcttggcacaagatagggccaactagtagatccttctgaaacaaggcaagaaaagacaccattgaaaggaatagttccagggttgggcccaggcggatgaagagctctggagcaaacccccaaagcccatctgtagggtgggcagacctcagtgttacctcacaatgggaacaaagggcctgggagtgctcagatgagaggagaaccacccattgccactgaaaaagtgaggatgtaggagccaaaaaaaaagtctgagaccagccctgccagcttactagcaggtcccgtcagtttgggcttctgtttctcaccaatgaaatgaataggagaagttcagctctcagatcttgcaactctgagagtccttttcccagcttcagctacctttctcctaccaaacgtgactggatagtcctaggacatatataatgtatcattatatatgatactgtggctttagggtttagaatttatttgagatggtctatggcaattcattcattttactcattggaactgagcctcagagagacagaggcatttgttcaagttacactttacaaccagcttgagaatctgtgggttctcctgtgaccactcacatagaccctaagattccttggtcacaatttgcatatggttgtgtgagaacctgtgacccctcacttagacccttggagtccttgatcataatttgccataggaaggtgcagaatggtggatatggtggggtggccctcaacatccactccaaccacccttcaatctgcctttcagtactgtagaggctagaaagagtagaatacatgctgtattatctcattaatataaagttcaagagcaggcaaaactaatttatggtgacaaaaatctagacagtggttattgggtatgtgagggaggtgatgtttgactgcaaacaagcaaaaagaaactttctgggtaagttgcaccagtgtattcatttgtcaaaactcattcaactgtacacttaagatctgtgcattttattgtatataaactacactttaaaaatttcaagtaactaccttagagggatgttcatatatgaataggcaattcatatattgcctattacatagtaggtgctcaataaacagtagtagcaggggcactagtaataattattgatattaatattaatatattggctttcttttggtaaaatttgcctgctaaatctttcctatcccttttactttaaactttctgcattcttatgttttagatatgtctttcataaatattattttgatattttcaaaattattctatttattgtattaataattacagatatatttatagtcatatttaccttgttattttattctatatcttccacctattatgttttttctcctttactgagtttcttttagattaattttcccttattttattttgttttattctctagtaatttggaacttaaagactttatttctattctctagccataccctagtaattttaacatgtataaattaataaagtattaacaaaaagttaagcaatatctttagtcactgcagaaaatataggcacttaaaaaaatctctattcactgcattccattttttataataataatgtcacatattttaagtttcttttccttatgctccataatactttattattagaatcaagatttacccatacatttacctctcttgggttctttatttccttttgcatctcagatcttcttctgaatatggactttaaattttcctttagtgaagttctctccaatttcttttgtttgaaaatgtcttcattttgcacttaacagatagtttatatcctctcagcatattgaggtgatcattccagtaccttgtggcttccactgctgttaagaaaacagctgacagactgactgcaaatcttttcttttccttttgaaatttcttttacactgcaacccttttgaatgtaacacttttcaccaatctggctgactttagatccctttaaagttctgaagtttcactataaagtgtccagatacgtgtgtcctttatttatcctgcttggaattcactgggtctcttgaatctgtgggttggtgtctttcatcatttctggacaattctcagccattatcttttcaaatatttattctaccatattccctcttaacttttcttctgcgagtctgatttgatgttgccttagtcagtttgggctgctataacatattaccataggctgggtgacttaaacaacaaacatttatttctcacagttccggagaccgaaaagtccaagatcaagttgccagccgatcctgtgtctggtgagagctcacttcctggcttccatgtggctgtcttctcattgtatcctcacatggcaaagagcagagaggacacaaactctctcatgtctcttatttcagagcactaattctgggctctacctcatgacctaattacctcccagagatcccccttcttaataccatcacactgagggttaggatttcaatacacagtccatgacagatgtaggatatatttaggtctttcattctattctctattttccctcacttttcttttagatttttcatcccttggtctctgtggactatattatgaataatacctttcccagatctagttctgattcactaattctgtcttcactgtgcataatctcctatcaagcccatccatttcaactaaaattaactcaactaaatttttaaaattcaattaatattcagttttaaatttcaactattataattctattttctagaagttttatttaattaactttccatttcacctgattactcttcagagtatctttctccttgtacatatcttccagtacatttttttctgttactaaatatgttaaaaagagctacttttcgtttgtatcatacatttctcttttgcaaagttcttgtgctatatttaaattttctcttgttttgctgtttcttggaattttacttacataaattctttaagatctgaaatgaaggtgagtccctcctgaaagactttgtatttgcttctgccagcagctggcaactatcagtctaggttcttgtgaactacattctgggctggaggtattctggaccaccatggtagatgaagtagactgtggaacagagtgaaacttgaattctcattccacattttagccacaattttactccatcctctgggcactaggttcaggacagtcactttttttccaagtcccttgattgggaggtagggaaggaatagggtgggggtgggatattgatttatttccagttcactcttactctgaggaagaggtcctcagctccggaatttgtctcatgccccataaggccatgatattaaagctcaacttcactgggttgagcaaatacccgtgggagtgaagctgtagctgcattccactcaggtctcagagttcctgtcttcacctggctgagtgagtactcacctagaaattccttgctctcttgatctcccctcaatattattaagaatttttttaaaatatgttattcaggccgggcgtggtggctcaggcctgtaatcccagcactttggaaggccaaggcgggcggatcacctgaggtcaggagtttgagaccagcctggacaacatggtgaaaccctgtctctactaaaaacacacacaaaaaaaaacagctggatgtggtggtgggtgcctgtaatcctagctacttgggaggctgaggcaggagaatctcttgaaccagggaagcagaggttgcggtgagccaatggcctgccattgcattccagcctggcaacaagagtgaaactccgtctcaaaaaaaaaaaaaagaaaaaaaaaaaaaaaaaaaatatatatattatagtagtatattatagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcattgcggaaggtaaaagcagtttcacatggtggcagagaagaaggtttgtgcagggagactccctgtttttaaaactatccaatctcatgagacttattcactatcacgtgaatagcacaggaaagacccacccccatgattcaattacctatcaccgggtccctcctacaacacatgggaattgtgggagttataattcaagatgagatttgggtgggggcacaaccaaaccatatcaccatggctgctccacacccctcacatgcccaatacgtggagctaaacagtgaggtatccacctgcctgggcctgtgggtgcctccaccagctgccagtccctggatgatgcagcccaaagaataccctgccagccccgagggagggttcagcaactcctccacccggagctcctgctgccaggacagggccagcaggacctcgtaagtgtcctttgctccacagaagcttctgggcttgagaccttgcacctgaaaacttttgtggaatttttcttctttctagtaatccaaagagctaaatctgtgctctcctgtagttcttgacagacaagcaaagaggtgtagagaagttgtgttagtagcaaaaataatgctccatgaagtgatgctttgaatcctaagcataactccttagaggcgcattcattcaacattcaacacctgggaactgtggaactaaagcaatgaacacaacataccatttgggtccctgcagctaaggatctcacagcctagggaggaagatatgtacacacagaagtgaaattccagggagtgaactcagtgttctacaaggattcagaaaaggaaggtgttatttccagatggtgaaaatgggcaaggctttgtgttagaggagccaagactgatctagtccttggagaaatgatgttgccagtgaggatacccaaaaagcattatctacctccactgaagaagatagatcaagctttatccagcagaatagtaacaatggtattgatttcagacaataagcatcaactgaaataatccatgcaacaaacaacacagtacctggcacacagtaactgttcagtaaagggttagctaattctacggacaggcacggtggctcatgcctgtaatcccagcactttgggaggccaaggcaggtggatcatgaggtcaggagttcaagaccagcctgaccaacatggtgaaaccccatctctactaaaaataccaaataaatttagccaggcatggtggcgggcacctgtaatctccagctactcaggaggctgtaggcagagaattgcttgaacccaggaggcggacggttgcagtcagccgaggtcacgctactgcagcctgggtgactgagtgaggctcagtctcaaaaaaaaaaaaaaattagccaggtgtgtggcgcacacctgtaatcccagctactcgggaggctgaggcaggagaattgtttgaacccaggagatggagcttgcactgagtcaagatcatgcccctgcactccagcctgggtaacagagcaagactccgtctcagaaaaaaaaaaaaaaaaaagtttagctaattctagcctgactcagactagctgcccggatggtgagaaacccaaaggcaatgaccaggccttatttacctctatatcctcctaatacagagcctgagcacaaggagctcagtaaaggtttgcaaaatgaatgcatgaacaaaaaagggatcttctatatcaatctcttaaattacacaggagggaagatcttttttgagaatgagtatcgttgaatcttggaatgggtttctgaagaagtctatgttattgccaaaggtcttctaagaagataaaatggtcatctgtccttgaaggtctaagaggccagcctgcttgaggtctgtttctacgtgtgttcaagcagttggctgtagtaggaaaaagtcaagcattttatgagaggaagagaatgttgagctaaatggcttctaaggatgcaggataacatgtggctaagacacagagaaacactcagattccagtcccagttttgctattcctatattagttgtgtgaccttgagcaggctgtccccattcctgagcccaaaccttttaaaatcataggtaacaatgatagactggattaagaaaatgtggcacatatacaccatggaatactatgcagccataaaaaatgatgaattcatgtcctttgtagggacatggatgaaactggaaaccatcattctcagcaaactatcgcaaggacaaaaaagcaaacactgttatgttctcactcataggtgggaattgaacaatgagaacacatggatacaggaaggggaacatcacactccagggactgttgtggggtggggggaggggggagggatagcattaggagatatacctaatgctaaatgacaatttaatgggtgcagcacaccaacatggcacatgtatacatatgtaacaaacatgcacatgtaccctaaaacttaaagtataataattaaaaaaaattttaaaaaataaaaataaaaaataaaatcataggttaaaatgctgagaagaatatccactgcttagagttgttgagagagtgaaatgaggccatagggataagcatcatgcaactagcacttatacctgggatttctccctacaatcctgtgcagagcagtatctcaaactggttcaggcattctgtggattttctgcctattccagagatgtgaaagctttacccatttcacaaggagctttctcctcaagagctcaaaatgcagcagacggacggccaggtgcagtggctcacgcctataatcccaggactttgggaggccaaggtgggcggatcacctgaagtcaggagttcgagaccagcctggccaacatggtgaaaccccgtctctactaaaaatacaaaaattagctgggtgtgatggcgcatgcctgtcatcccagctactcaggaggttgaggcaggagaattgctcaaacccaggagacagaggttgcagtgagccgagatcatgccactgcactccagtctgggcaacagagtgagactcggtctaaaaaaaaaaagtcagcagagtaaggaaatgctctttatcacttgtctccaggatgctccccaagtgaaggccaggctgcctgttctggaaccttggatgcaatgagatccatagttggcaacggtgccaagagaacaaagaagaacaatgcatctgagagagccactgtgacacctagagctcacttctgcatggccagctagggcctggagatgcagccaggggaatgagttgggagctaggccaccccttgctcctcccaggattgcctccctcagtaaaaacacctggtttttgaagactgctttttttctgctgagggacaatatcatgaggtcacagaaattgcaagtgagacaacaccatggaggtcatctcatcctgtacaccctgcctcctatcagtcaggatttagagtagaaaacatactacttgaggcagaaaaatatcagaaatatatttaggaatggtaattaaaggcttacatagccattagaaagattggaggagagaattccaggctggacttcccagaaacatgtctctggagttgccgccagggagagccaccacctccaccacaatcgggaggctgaagcctgagtccctgggggaccggggtcaggagcacgaggctgtagctgtgtcccagggatctgctggtgctgctgctgcagtggcctctggacacccattttgaccttcctattttctatctagaactgtagcttccaggagtctgggagatgtaactgttcactctccagcctctgcagtagaggaacgcacaccaaaataatgtaactgtccttcaaccctatcccacatccctccatctctgtctgaataccctgagtggcagggagctcgccttatgttggagagatctgagtgctgtgattagggtgaaagttgctgcacaggggtccccactggaacgcatggcactgtctccccctcgccccagtgacagcacttccgagaggggcagggtgtgagtatgtatggccatcctagtttccaagaagtcctttcaggctctactcctaagacatagtttcctggcccctgacaacttaactcacctctgaacaggtttcagtctgacaaaactcttaacaaagtgaaaaataaggaactaagccccaaaaggcaaatgaaccccacagggagctgcgactcaggacagaaagtgtgacacatggtggttgccagaacaggtgcaaatagtccctgtcaccctctgctggtggagaagcaattgaaacagctccctgggggtaatttgccgatgtctctcaaaactctaaaagcacttacccttgacccactcactatctccacttctgagaatgtatccaacagacaagccctcatgtatatataatgtgtatatgtgtatgtgtaatatgtataatatatccacaattattcatttcagcttggctgagagtggcaaaagactgaagcaaccacatatagggggctggctaaataagccatgatactgtggggtaaagaaagagagatcagactgttactgtgtctatgtagaaaaaagaagacataaaaaactccattttgttcatgtactaagaaaaattcttctgccttgagatgctgttcatctgtacctgtagccccaaccctgtgctcgcagaaccatgtgctgtgttgactcaaggtttaatggatttagggctgtgcaggatgtgctttgttaaaaatgtgtttgcaggcagtatgcttggtaaaagtcatcgccattctccagtctcgagtacccagggacaaaatgcgctgcggaaggccgcagggacctctgcccaagaaagcctgggtatggtccaaggtttctccccactgagacagcctgagatatggcctcgtgggaagggaaagacctgaccatcccccagcccgacacccataaagggtctgtgctgaggaggattagtgaaagaggaaggcctctttgcagttaagaggaaggcatctgtctcctgctcatccctgggaatggaatgtctcggtgtttaacacccgatcatatgttctatttactgagataggagaaaactgccttatggctggaggtgagacatgctggtggcaatactgctctttactgcactgagatgtttgtgtaaagtcaaacataaacctggcctacgtgcacatcaaggcacagcacctttccttaaacttatttatgacacagagacctttgctcacgttttcctgttgaccctctccccaccattatcctatagtcctgctacatccccctcaccgagataggagagatagtgatcaataaatactgagggaactcagagaccagtgctggcgcaggtcctccatatgctgagcaccggtcccctgggcccactgttctttctctatactttgtctctgtgtcttatttcttttctcagtctctcgtcccacctgatgagaaacacccacaggtgtggaggggctggcccccttcagacacaaccaacagaatagcatgcagttgttaaaatgaagaatgaacacatctattgtgcactgatatgcacaacatccctccttaaaaaaataagggtagaagtgagtttaatactgcaaagaaaagtatgtgtgtatggacataggtatagatagatagatagatagatagatagatagatagatagagggagagagagagggactatctctggaaggatacatgagaaactattaacagtgattgcttccagaaaggggaattgggacttcaggggtcacaggagggaagatttactttttattctataaacttttaaaatatttatatttttaccatgtataatatcacttattctggtaaactatgtatctatttaaaaataactaggccttatagtccaaatacggcctgtgttctgaagagaaaagtcaggctgtgaatttcgtttctagataacattttttgtaaatacagacttgggacacgatgggttttatttttgtttcagtcatttacctaattaatttattcactcatcatccatccatccatccatccatccactcatccaccaacctgtccatccatctacccatccatccatccattggtccccccacattcacacagtgactctctacactgggtatttgcaagaagcctgtctgccagctcttccccaggcagttggctctggggccaaggtcagcagtggccagcctctctcttgccttccttctcttcctccctaggtggttgcaaaccctgatctacatagtaaaaggcaacattgacttgcagctcctgagcctgccccaaccatgaagaatgtgggcatcttggtaagaggggctgggagtggtcctgacagcggcgcggggcggggcgccggggcgtggaatgtggggtggggatgtctttggtgatcgtacatttgcctgaaagcaaacctcacctgagtgacatgggacacagtttgacatcaagtgtccttgtgaccatttctctctcaggagtccccattaacaggttgactctgctgcacaacttgggatcagaaagtctgagttcaccccagctctgctgcttgtaagccaggtgagcttatgtgagccttagccctttttttgttgtttattttttaacagctttgttgaggtatcctttatacaccatataatttattcatttttagtgtacaactcaatgaattttcagtaaatttacaaagttgtgcaaccatcaccacaatctaattttagaacaaattgcattgcccctaaaaactttctgtttatttacagtcactccctctctagctcttttgagcctcagtttcctcacttgtaaaatgggaattgacagcttagttattagaaagattaaattaaacaattttgtaagattattttgtaaactttagaatactcgacaatcaaatggtttctattattattattatttattaatgattattctcatctcatttattccctaggccagaggatcatacctgggtcttaggaattccataagactcatgaaattgtaggcaaagtctagtgattaatatctgctctttttctgggagataaatttatttcatgcaaaatgagtctgtgacaaaacaaaaaaagcagacaaggttatacatgtctctagactgtcatgtggagtgataacccttttcttcccttttgacttggaagtccatcttgtcttcccttcctaccttcttagcttcgcttgtctgccttcttagctctggagatcagttttgtccctaaaacctgtcctctgcctttcttcctccagcatcactgaaacccccatcccttcgccttctctgaagttgctgcacactttgggttccatcattgttctctgtgatattagaggtgactgggagagtctccatgttcaaacccatgtcctgtccaacataatgtacttttattgccagactctccactctccacacccaggcaatgagaggctgtttctgcagagtggttgagagggagggtggcataggcagccccgcctgccatggtgtcttattgcccattcatgtgaggcgacttgtacatttgtaccaatattatcaaatggcagagttcttagtcttcccgtgtacatttcttaaatattcaaggtttttgttttgtttgtttgttttttaatagatcgtattttttctagtagttttaggttcacagcaaaattaagaggaaggtacagagatttcccatataccctctccctacacacactcactgcctctcccattatcaacatccactaccacagtagtacatttgttgtatcagggaagctaccttgacacagcattatcacccaaagtccttagtttacattagggttcacttttggtgttgcacattctatgttttttggacaaatatacaatggcatgtgtccaccattatagtatcatacaaagtactttcactgccctaaaaatcctctgtgcttcatctgttcatctctctctcccacaacccctggccaccactgattttgtttactgtctccatagctttgacttttccggagtgtcatatagttgaaataagcaatatgcagccttttcagattggtttctttcacttagcaatatgcatttaaggctcctccatgtctttttatgacttgatagctcatttcttcttagtgctaaataatactccattgttcctgtgtgtcattgtttatttatccattcacttaccgaaggacattttgtttgcttccaagttttggcaattatgaataaagctgctattaacattcacatgcagggttttttgtgggtgtaaattttcaactcatttgggtaaataccaaggaatgcaattgctagatcatacggtaagagtatatttcattttgtaagaaactgccaaactatcttccaaagtggctgtaccattttgcattcccgaaccagcaacaaatgaaagttcctgctgctttacattctcaccagcatttggtattatcagtattttggattttgattgttctaataggtttgtagtggtagctcattgtagtatggatttgcagttctctggtgacatatgatgtggagcatcttttcatatgcttatttgccatcttctttggtgaggtgtctgttcaggtcttttgtctatttttgtgttgtgtgtggggagtggagtggggcacagggtctcactctgttgcccagaatggagtgcagtgatgccatctcagctcactgcaacctctgcctcccttgttcaagcgattctcctgcctcagccttccaagtagctgggattacagacacgtgccactactacccagctactttttgtatttttagtagagacggggcttcactatgttggccaggctattattattattatttttagatggagtctctttctgtcacccagactcaagtgtagtggcgtgatcataactcattgcagcctcaaactcctggactcaagcaatcctcccacctcagcctcccaagtagctgggactacaggcaggcaccaccatgcccagctaattttttaaatatttttaagaggcagggtctttctatgttgcccaggctggtcttgaaggaagactgaatactctgccgtttcagaggttcctgcctccacttcccaaagtgctgggattgcaggcatgagccactgttccaggcccttttgtccattttttaatctgattgtttcttttcttatctttgagtttgaagaggaataacagcccttcatcccacgtcttttacaaatactttttcccagcttatcgcttgtcttcttattctcttaacaaatctatttttgtcctatgtttttcattctaacatacctcttcaactctcttccttctgcccacatcccatctccagctggttcttgtcagcctgttggtaacatgcctcctggccatgcaccgtgtgggtgtcctggtgaaatgtgcctgcactttcaccacaggtgagagcctctaagtccctttgcaaacacaactttctttgctttactccccagcatgtttttcccactctcctgctatctgtgttcatgcacctgccagaataaggcctcttgatcacaccccaccagccacaagctggctctgtttttttcctgcagtttccatcacaaaagtggtgtccttttttccactttctacacagtttaaaaaataacatgaaacatgcttttaaaaactctacaagacagccgggcgcggtggctcacacctgtaatcccagcactttgggaggctgaggcgggtggatcacaaggttaagagattgagaccatcctggctaacatggtgaaaccctgtctctactaaaaatacaaaaaattagctgggcatggtggcacatggctgtagtcccagctactcaggaagctgaggcaagagaatcccttgaacccaggaggcagaggttgcagtgagccaaggtcacaccactgcactccagagcctgggtgacagagtgagactctatctaaaacaacaacaacaaaaaaaaaaaaagaaagaaagaaaaagaaaaagaaaaaactctacaagatttgcctggcgtggtggctcatgtctgtattcccagcacctttgggaggctgaggtgggtggatcaccttgagcacaggagtggagtccaacctgggcaccatgctgaaaccccatctctacaaaaaaatacaagaactagctgagtgtggtggctcatgcctgtatttccagctactcgggaggctgagatgaggggatttcttgagctcaggaggtggaggttgcagtgagccaagatcatgccaccacactccagcctgggcacagagcgagactctgtcaaaaaaaaaaaagaaagaaagaaaaagaaagaaaggaaaaactacaagatttcttaaaaaataatcccttttacatttattatttataaatatattttaaaaggtctggacttaatcactccaaactattaaaagaagtggtgaggagaactacattgggatgaggcagggaggatacgtatagggacattcctttcttactttatagacttctgtactgtttgactttttataataggtactattactgctatatttttaaatgaagttgggaaaataagcacattccctctcatttcctgaaattctgatgcactcttaggattatgagctcctgcgctcctggtaaaaatcattactccaaggggcggcatgcacgatcatccccatcattagcaggaagaccagcagtgtgcatggtctctgggaagcagcagcgtgtcataggaaaatcactgttatgggagtcaggaggcctagggtcaggtcctgactctgtcctcagctcactgtgtggcttcggaaaagtgccctgcccgccatgggccaaagtgacccaaggcattcagtgaatgcatgggactcattaattcatttgactgacagctccagaaggatggagccctgcctattttattcactgacatggaccctagggccttgtataactccaacactcagtagccattcaatacttgttcaacgagttggcacatgatttttggagcccttcagggaaatgagggaggctcagtgggcaccagtgggtattggcacctaccacttctgccaaatttcctactatacatctttccattcagccttgtactaggaaaagatctacctttctctctccctatgttatacttctgaacctaacaaagtatcctgctctcccccacactcaataagcccttgatggactatggagatactgcaatgcagtgctagaggccagcccccatgcctggctccctgaccacgcccactgggggaggtatcttgtcctctccttgcctgggatggggaaggatggcagatcccgttgaggtcccacaaatcctgtagtccaatgttgatatctgtccctctggaaatacagttataattaattttaatactttcagatatcctaaagagttgttctcaaagttgatccccagtccagctgcatcagcaccacctgggaacttattagaaatgcaaatacttcagccccacccagacatactgatcagaaactctgaggatgggacccagaaatctgtattttaacaagacatccagatgattctaattcacacaaagtttgagaaccactgccctaaagaaactactttacattcttgacaacaaaggcagcttctgggggcaaattaatatatcagaaattgctatttcctgtgcttagctgagaattttctttagtcctaaaatcaagacagccatgggacaataatcaagactcaagatgtgtacatgggtccagatggattcctacagggacacagccagagctgctagaatccaacctactaaaagtacagatggggaaatcaggccctaaagacagaaagcaaccttcccaggggtacacagcaaatcatgatagggttgaaaattgtgatctgagcaaaggtgttatcgaaatatggtcaactcctggtgtattagtccattttcacactgctataaaaaactgcccaagactggataatttataaaggaaagagatttaattgactcacagttcagcatggtttgggaagcctcaggaaacatacaatcacagcagaaggcgaagaagaaaccaggcactttcttcatgtagaggcaggcaggagaagtgccaagttaaggggtaaatagccccttataaaaccatcagatctcatgagaacccactcattatcacaagaacagcatgggggaaatggcccccattattcaattacctctaccgggtctctcccttgacatgcggtgattatggggactacagggtttacaactcaggatgagatctgggttgggacacaaagcctaaccatatcattccaccctggcccttcccaaatttcatgtccctttcacatttcaaaaccaatcatgccctccctagagtctcccaaagtcttaatttattccatcattaacccaaaagcctaagtccaaagtctcatctaagacaaagcaagtcttttccacctatgagagcctgtaaaatcaaaaacaagttagttacttcctagacacaatggtggtacagacattgggtaaatacactgattccaaatgggagaaattggccaaacaaaggggctacaggctccatgcaagcccaaaatccatctgggcagtcaaaccttaaagctctgaaatgatcgcctttgactccatttctcacatccaggtcacacggatgcaagtggtaggttcctatggtcttgggcagctccactcttgtggcttcacagggtacagtccccctcctggctgcttttcatgggctggtgttgagtgtctgtgtcttttccaggtgcacagtgcaagttgtcaattaatctaccattctgggatctggagaatggtggccctcttctcacagctccattagacagtgtcccagtgggaactgtgtggcagctgcaaccccacatttcccttcctcactgccctagcagaggttctcccatgagggcccctcctctgcagcaaacttctgtctggacacccaggcatttccatacatcctctgaaatctaagcagaggttcccaaacctcagttcttgacttctgtgcacctgtaggcccaacaccacatttaagctgtccatgcttggggcttgcaccctcttaagcaatgacctgagctctatgttggcaccttttagccatagctggggtgcaggccaccaagtcttgagacttcacaaagcagtaaggccctaggcctggcccacaaaaccattttaccctcctaggcctccaggcctgtgatgagaggggctgccatgaacacatctgacatgccctggagatgttttccccattgatttggtgattaacatttggctccttattgcttatgcaaatttctgcagccagcttgaattccccccaccaaaactggttattcttttctattgcattgtcatgttgcaaattttctgaacttttatgctctgcttcccttttaaatataagtttcaattccaaaccatctctttatgaatacataaaactgaatgctttcaagagcactctagttacctcttgagtgctttgctgttagaaatttcttccaccagataccctaaatcatgtctctcaagtttaaagttccacagatctctaggttgggggcaaaatgctgccagtctctttgctaaaacatagcaagagtaacctaggcctaggaggaaaaaatggtttcgtgggtagggcccaaggccttggtgctttgtgcagtctcaggacatagtgccctgtgtcccaattcccaacaagtttctcatcaccatctgagaccacctcagcctggacttcatcgtccacatcactgtcagtattttggtcaaagcaattcaacaagcctctaggaagttccaaactttcctacatcttcctgtcttcttctgagccctccaaactgttccaacttctgcccattatccagttccaaaataatttccacattttcaagtatctttatagcagtgctccactacctcggtaccaatttactgtattagttcgttttcacactgctatgaagaactgcccaagactgggtaattaataaaggaaagaggtttaattgactcacagttcagcatggttggggaggcctcaggaagcacacaatcatggcagaaggcaaagaggaagcaaggcaccttctccacaaggtggtaggcaggagaagtgctaagcgaaggggggaagagccccttataaaaccataggatctcatgagaactcactcaatattgtgagaacagcatgggggaaatgtccccagtgattcaattacctgcacctggtctctcctttgacatgtggggattatggagattttggggtttacaattcaagatgagatttgggtggagacacaaaatctaaccatatcacctgatcatcctggattatcctgagtgtggatggacagattctggtagctaaagtttgtagtcacctatctccgcagccaggggacaccctgacaccctgacaccctgacaacagagctgttttgttttcttcaacagctcttctttttttttagtctttagttattaggtggcaacagattgaataatgaggttatttctttgatactgctctcatagtgcaaaataaatcattgtcaatttagcaaaggtccagttttgataaagcatttaccagcaatcatgtataagaaatacattttggcaccacattgtgttgtaactgcccttcggagtggtcttggaacaatttcctcacttctattggctctgttacttgtgatcaaagcagaaagagtccagatccaaggcaagctaggccccaggacttgggcagtggagatcatccagctctagttgctgcagtaagcagggcagagaagctaagaggtgcatgtaaacacaaagaggacaggataaggaggctcctgggatgcctgagatggtttctgaacctgggcattaggggatgccaggcagcatgtggggacttaaagtcagatagactctgtgtactttcttttttgttgttattttttgagatggaatttcactctgtcacccaggctgccaggctggagtgcagtggcacgatctcagctcactgcaacctccgcctcctgggctcaagtgattctcctacgtcagctccccagtagctgggattacaggcacccaccaccacacctggctaattttttgtatttttagtagagacagggtttcaccatgttagccaggctggtctcgaactcctgacctcaggtgatccacccacctcagcctcccaaagtgctgggattacagacatgagccactgtgcccagcctgactctgtgtactttctagaagatcagtctattcatagagaaacggggcctcattcactccttaattcattcatctagtgactggacaaacatcaatcgagtagccactataggctgagcatcatgctgtgtgctaggaaaatagagacaaacaaaatagacacaatctctacctcaatggagttttatgaccttgtagtagggacagaaaataaataagaaaagatacaaatgtataattatgaattaggataagagctgcaaagaggtggggaaaacttctctgaggaggtgaagtttaagctacgagttgaagggtaagtgagagccagccctttgaagaggggtaggaagaactgcctagggaaaggtatcagcaaaagactgtgaggtggaaagagctcagaggactgcaggaactggcagagcaaggaggagaagtagaagagaagaatggaaaggtcagcaggagtcgaaccactcagtgacttgtaggcaagttaatacatcagaatgctgttcccagagtagagggaagccccagaaggcttccaagcataagaaggacataatataatcaatagtcttcaaaagatcagtctagatcttgtatgggacatagattgaggggcaagagtggaagttgattttttgcatgggggaagggacagccaagaccaagcagagtattcagtgtcaaagtcaaatcagtcagaattgagaacagagtccctccctctccaagaagatgaggttgggtggtggatgataggaagggagatcaaggcaggccctcttgactccataccttgacgcaaaggctctgcctggaaacatacctggacataaatgtaatgagcctgccagggtattcctgccccttctggagctggaggaggtctgaggctacaagccaggcttctatctgtggctgtgagaagtgagggcatcagataagtgaggtaaggctggagctgaaaacaccagcacatcagatggccacatattcactttcccttccgtctttttaaaacaatcttctcccaatgcccagggacattgtgttcttcctgactgtggaccagctgggcttctgctgtgtgttcctgatgcttctggcagataacctcaaacaagtagggcagagaactcaagcagaaatacaagatggcacgagatagcccagcttgagttttaagcagctccatccaaatcaaccaggtttgtgaaagcctgtgaaattcagcctttgcttaggacactccaggtccttctctctgagcaacgacagatgaaacaggatattttttcaacttgaaaattgtcaatatctccttattggacaagatatattccaaataccttaatctggctcacaagaccctaggtgctctggtccctacctgccctccagcctgatcttttacttctctctatatgcttcaacacgtctgggctatctaccattctcaaatagattgtgcattttcccaacactgagcccttatttatgctgtttttcctataggtaacatgctcccttcttgtctctcatctccacgtatccaaatcatacccatcctaaatgctcacctcctctgggtatcgttccctgagtcacacagcggaatcactaccttatttttctcttcttaatttaatcctactgtttaaatatatttatagttttccttgaatacagttatgtcttctttatagctagcctgtgagctcatagagggtagacaagttgctttggagctcttataacaaagtaagtacttggcaagtatttgttatatgtgtattttgagcaaataggtctgtacattctagtgcttgaagaatttcaagtggtatagccacttaaggcaggccacaaagcactgtgttcacttagatcttatgtttgtaaatatattatgttggcatatgtatatatatacatatatatacgtgtataaataaatataatatctactgccaatatataatatacctttccgaaatgaatctacaggtgcatcttttatattcattttaaactcttgtttattttttatgatgtctcttgagtgatacaaaatcttcatggttggtttcttcccctcagtacacaaaagcaacacagctctttcttaaacaaaaggaaacaatagcatgagactataaaatataaaaggtctccataaatttctcctcctgcaaaaacacacattaaaagttatgtgaccatcagtaaaatgagggaataaaaaataaaaaggcgaaagttatgtgaatagtttttcagttttttcataaatattcaaacatgcatatataataatttttcagactatgatattgatatgctatttgtttttttccatgcttaatatcatggactcactatatataatgtattcaccaagtccttaaggacagacattttggttatttccattttattttatgttattgatatcataaacaatacaaaaaaactctgtaaagagtctccaaagacaatttttcactctttatattttatatttgcttctttatattttcaccatcataaaacaaaatccatatttggaaaaaaaaaaaagatgcctaggtcatctctctgtccctgttcagaatttcaccactctctttcaatgaatgaattaattcattgaacaaatacatattgaatatctatccttgagctggccactgtgctggtaatacagccgtgaacaaatcagataaagttcctgccctcagacacttacattctagtgggaaagataaacatttagcaataatcatgctagtgtaaaatgacaaagcatgataagccctattgaggcaatggactggtgctataagagtaggggtctgatggagtttggagggaacattgactctgaaggctgagcagtcactaagaagggaattttgggagacaaggtttttggcagtgagaaaatctccagatgctggtgcttttaagggctgaagattgacaggaatggctggaggacatagggatgggaacaggcaggtcgcagctaaggttcacatcatccttttttatccataggtgatcaagacaactgatgagatcatagctgactgccagggcagaggcgtggcgattcccacacccaccgtggatgtcacatctacacagtgttcacatttcccttgctggtgctgctggtgttcctccagagcctctgtgcgctgcctactttctagatgctgaacaaagtcttcacgctgggaagcctcgtcctcatcctccagcatctcctccaggtagattccccaccccatgcagtcaccttgagaagggtgtgcgtgtgtatgtgtgtgtatgtagaacaaagcctggaaacacatcctccagattgtcaatgatttcctctagagagggaaagttcaggttgttgtatattttcctatatgtgtctctattgtttgacatatatatggaattatcacacagaaaatttctgcataatgcccaaactccggggaatgaatatatctctctcattataatttttccccatgtttatataggaaatatttacatttctgtccccaaatgcaatataacatatttaacaaaacaacccatgggaaatatcttgagacattccttacattgtcttaccttacagatttagttaaatgttaggacccacacagacagtttggaaagagaacaagcatccacaaagaggatgtggaggatgtttgcagacaaaagcaatttcttgtgacaaccatattcatttgtgtttagtatcaagttttaagcattcatagactaacgtcatagtttgttgcttacatacaggcattttacttgttttagttacgtcttaagaaatggttgagtatttggggtggatgttcatgtcacaatttctcctatttaaaatagtaggaacttggttgtcagtgatttgcccagatcatcagatttttagagcatattaatgctatgaaggaggtttggtttggtttggtttggtttcaacaagcaggtattttcttatccgtgggaaaaactgtactaaggacccttgttcaactcaagttgaagtaactgggggaaaaagagactattagaaagattctgggaggtgtcaaggaacagtcaagccctaaaaggatcctgaggcagtcagtctttgcaggtcacaccaactcaggggtggacccccattagggctcccgaagcctttgctcagtttggctctgtgtattggctttatacctctctcttaatgtgagctggctctgtccacagcttctgagttttacattttacaatttagccaccagaaggagactaatctgatgttctctcaggtctcaaaatttcaggaaaggaattcattggttcagctcaggtcaggtgccaccctggatcaatctcctatagttgggggcaacaccaatagaaactatacctgatacagaaggagttcaggtcacttaaggcatgtgggtgatggttgctgagcagatcatcccgtaggtatccatgacaaagccttgaagaaataagataaatcgggagtaaatatttctccttctgctttgctcatttatgaggcagaaatcttcctcctgacacccaccatggatgagaatcaacggataggtttgaaatgtgaatatgagtcctagctttgctgcttataagctctgtgaccctggataagtcacacttttaaaataaggctagtaacttctctcttgataggctgttttggtgtaaaactacaagtgagaacacagtagttcttagagtcagcagaatgggtacaagtatagactttagaccagtggttcttaattggaaatgactttgctctccagtggacatttggcaattgctggagatatttttcgttgtcacacagcggatagaagcaagagatgctgtaaaatagcctgcaatgcacaggacagtccctcccaaccaagaattatctggccctgaatgtcaagagtgctgaggttgagaaactcttgatacagttgcatctcatgcaaacaatagcatgagactataaaatataaaaggtctccataaatttctcctcctgcaaaaacacacattaaaagttatgtgaccatcagtaaaatgagggaataaaaaataaaaggcgaaagttatgtgaatagtttttcagtttttttcataaatattcaaacatgcatatataataatttttcagactatgatattgatatgctatttgcttttttccatgcttaatgatatatcatggactcgccatatataatttattcaccaagtccttaaggacagacattttggttatttccattttattttatgttattgatatcataaacaatacaaaaaactctgtaaagagtctccaaagataatttttctctctttatattttatatttgtttgtttatattttcaccatcataaaacaaaatccatatttggaaaaaaaaaagatgcctaggtcatctctctgtccctgttcagaatttcaccactctctttcaatgaatgaatgaattcattgaacaaatacatattgaatatccttgagctggccactgtgctggtaatacagccgtgaacaaatcagataaagttcctgccctcagacaggagcctggtaactctggagccaagttaccagaattctgattacagctccaccatttcaaactttggcaagttatctctgtgcctcaattttcccaagtggaaaaggagacaatgctaatacctatctccgaaacctattgttaaaatcaaatggatttattcatgtaaagggcttaggattctgcctggtatatagtgagtgctccctaaacaaatgcaagttgttatttccccaaaacctggatgagcatcagaatcaccttgagattttgcttaataacagattcccaggctctgctttggttgtcttggatctgaatctgtggaattcagaacccaggaaacttcctgtagaaatacatttccccagctgatttggatgatcagccaagtacagagatgctgtgaatccctgctttgcagagtgtggcctttggaccagcgcaattgaactactcaaagtctgatgtgcacacaaatttcctgggggccttattacaatgcagattctgagtcaggaggtccagggtggggcctgagattctgcattcctgacaagcctctaggtaatgctgatgctgctggttcatagcccacattttgagtcaaaagctccaaagcactttgtacatgtatgttgtggtttccatgccctcaatcatgtgaggagaccaaaacgcctgttgaacacttggttatcagtgttttggagatcaagaaatgagatcaaatagttgccactgtttcttctttttgatagtcaaaagcaatgtaagtaaaaggaggcttgatgcaaactcctcagatagtctttgcctcctgagggccctcctgcctgagcaacaatgaaaatctatcccccccaccccaaccagatgcagtggttcatgaatgcctgtaatcctagcacttgggaggctgaggctggtggatcatttgagcccaggagttcaagaccagagtggaaaacgtggcaaaaccctgtctctaccaaaacacaaaaaattgtctaggcgtagtggcatgcacctgtagtcccagctacttcagaggctgaggtgggaggatcaccctgagcctgggaggttgacactgcaatgagccatgatcacaccactgcactccagcctgagcaacacagtgagacattgtctcaaagaaaaaaaaaaaaagaggaaagaaaagaaaagaaaaaaaaaatcaccctcaccacgtttcactccaggaagtcattcacttactactccccctggttggaaaagtttctaactgttctcagaaaaaacaaacaaacaaacaaatccttcctggaaaccagttgctataaatatcctggagcatcctgtttgcaagtggatttttattggtgtttattttcatggctgatatctctttaaaagcattgttctccagctgtcagtcctcgtcagactccagaattctgcattcttatagaagcagagatagggctggatttacaagtcatttaattcagtggtttttcaaggtgcatttccatgcttctggtggtgtatgtaataaatttggggaggggacatacaatgtttgttttcttaattacgtatttgtagtatgtatgtatattctcttctattaatggaaatgagagaattgcatcataatgcttctttgtaaaattaatcttatgttaaaacactgacttggccaggcacggtggttcacgcctgtaatcccagcactttaggaggccgaggcgggcagatcacaaggtcaggagttcaagaccagcctggctaatatggtgaaaccctgtcactattaaaaatacaaaaattagccaggcgtggtggtgtgtgcctgtagtcccagctacttgggaggctgaggcaggagaatcacttgaacccgggaggcagaagttgcagtgagtcaagatcgcaccactgcactccagcctgggtgacagagtgagactccgtctcaaaaaacaacaacagcagcaaacaaaaacaaaaaaaacactgacttgatgagaaaaatacaataaatgactcaagatatgctgttttagttcaactttcttactttatggaaggagaacctaaagctagagtgaccgtgagcctcgatttccttatccttaaaatgaagataataatccctgctttgtagggttgtggcgagaagtaaacagcgcatttaaagcactagcacagtgcctggcctatcacaagaacctacaaaatgttcactgcttatattatcttattagaggaggaactttattatgataatcactgttagccttcctgggcttcaggttcccaggtgtaaaatgaagcatcagaccagaggatttctaaggaccttccttctcctttcctaagcatctctggtcatccagcattctcattctctcattgaccccaaaaattggctccagagaatggcagagggcagaaggccaacttccatccccagacccaacaccccactgtattatatacacggagaaactgaggtttaaatgcttgtgtggccctaatgagaggtgaagccggctgggcttctgggtcgggtggggacttggagaacttttctgtctagctaaaagattgtaaatgtaccaatcagcgctctgtgtctagctaaaggtttgtaagcacaccaatcagcactctgtaaatatgcaccaatcagtgctctgtgtctagctaatcaggtggggacttggagaacttttctgtctagctaaaggattgtaaatgtaccaatcagtgctctgtgtctagctaaaggtttgtaaacgcaccaatcagcactctgtaaaaacgcaccaatcagcgctctgtgtttagctaaaggtttgtaaacgcaccaatcagcactctgtaaaaatggaccaatcagcaggacgtgggtagggccaaataagggaataaaagctggccactagagccagcagcagcaacccattcgggtccccttccaagctgtggaagctttgttcttttgctcttcacaataaatcttgctgctgctcactctttggggccatactacctgtatgagctgtaacattcgctgcaaaggtctgcagcttcactcctgaagtcagcaagaccatgaacccactgggaggaacaaacaactctggacgcgccacctttaagagctgtaacactcactgcaaaggtctgcagcttcactcctgaagtcagcaagaccacgaacccaccagaaggaagaaactccggacacatctgaacatctgaaggaacaaactccggacacaccatctttaagaactgtaacactcaccgcgagggcccgtggcttcattcttgaagtcagcaagaccaagaacccaccagaaggaaccaattccggacacactagaactgagcctctctcactctcaattcccctctgagcctgagggtttcctgctgctgctgtcttcttaaagaaacaaagtccacccaccaaaggatgaaggtcagcagaaagttcagcccatgtggagctctgctagctagctgtttcactttttgctttatttccactgggttttctcaagtccagttttaaggtagccattaccatttttcctgtgtttctctttcaagaaatcccagacgccagcagtctgcccctagtggcaaactggaagacctagtccctgttctttgggacaactgtctttgcctttgaaggtactgaagtggtaaggtttgagatagaatgagtgcccccatcccctatgcagagtgaagaaggtgcatggggtagataaagagcactggctctggagcctgacaggcgtgaatttgaatactgttttttttcatcctttcaagctattggatcttggacagctgttttaaaatctctctgaatccacagacatacttcgaagcctgctctgactctgccaagctcagaggacctgcaggtttctagggatctgcaggtttcctggtgacctaaccttcagctcaagccaccccaagagaggaagctgtgcaaactgccagggcccttcctggggctaaggaaatgcatgtgcagcaccagtgattggagggggcactcctaatgcccaggaagagacttgttgaaggggtcatcttttaccctctcatcccccgctttcctaaagtgttgctgcaaaggcactgaaacacaaaagaggcatgcagttgagtaacagcctatctgtaagccctcactcttaagcactatctactgggttgcagcctgaattgtactaccaaagataaatttcttcaccaagcaacatctgtaaaacccaatgtaggtaaataaccaaaactaaggaagccaaacagagtcttggccctctaaaagcacccagaaatgaagccaatcaactatacacaatgtatactacagtcaaacccccaaaagtaaaaaagaacacagaaacaaaagccccatccaaataacagcaaattcaaaaagataaagaaacaccagccccctaagatgagaaggaatcagcatgagaaaagccagagcattttcttatctctaaaggttttcttatctctaaaggttcacactagctccccagcaaaggatcctaactagattaaaatgtctgagatgacggatatagaacggcaagaaagctgaatgagattcaagaggtgttgggtgcagtggctcatacctgtaatcccagaactttgggaggccaaggcaggcagattgttcagcccaggaggttgaggctacagtgagccatgatctcgccattgtattccagcctgggtgacagagcaacaccctatctcaaaaaaaaaaaaaaaaaaaaaaaagagaaagagagggagagacttaagagaaagtagcaactcaacccaaggaagtcagtaaagcaattcaagagttgaaagacaacatagccattttaagaaggaactaaattattctggaattgaaaattttactacaggaatttcaaaatacagttggaagccttaataacaaactagaccaagctgaaagaataatttcagagcttaaagaccagtctttcaaatcaactcagtcccacaaaaataaaagaatttaaaaactgaacaaagcctttgggaaatatgggcttatgtaaagagacccaacctacaactcggcattcttgagagagaagtagagagagtatgcaacttggaaaacatatttgaggacatagtcaatgaaaatttcctcaatctcactagagaagtctatgtgcaaatgcaagaaattcagagaacccctgcaagatactatacaagacacacagtcatcagactttcaaggtcaatgagaaagaaaaaatcttaaaggcagctagagaagaatcagatcacttacaaaggggaaaccccattaggttaaacagtagtcttctcagcagaaaccttacaagccagaagtaattaggggcctattttcagcatttttaaagaaattccaaccaagaatttcatattccaccaaactaagtttcataagcaaaggagaaagaaaatattttctagaaaagcaagcactaagggaatttgttaccactagagcagcctcaaaagaaatctttaagggagttctaaacatggaaatgagagaatgatactagctaccacaaaaacacacttaactacatcgcccacagaccctataaagcaactacccaatcaaggctacaaagtaaccagctcacatcatgacaggatcaaaatctcacctatcaatattaaccttgaatgtgaatggtctaaacacctcatttaaaaggcacaaagtgggaagttggattaaaaattaagacttaaacatctactgttttcaagagacccatttcacatgtaaggacacccataggctcaaagtaaagagatggagaaaggtctatcacacaaacagaaaacataaaagagcaaggatcactgttctaatatcagataaaacagacttaaaaccaacagcagtaaaaaaagggcaaagaagagaattacataatgataaagagttcaattcaaaaagaagacttactatcctaaatacattcacacccaatattggagcacctggattcatataacaagtacttccagacctatgaaaacacttagccacacagtaatagtgggagtctttaataccccactcacagtgtaagacagatcatcaaaggagaagactaacaaattctggacttaaatttgacccctgaccaattggaccttatagacatctacagaataatccaccaaacaaccacagaatatacagtcttctcatctgcacatggcacatactctgagatcaaccacatgcttgaccataaagcaagtctcaatacactttaaaagacagaaattataccaagcatactcttgggccacagtggaataaaaatagaaatcaataccaagaagatatctcaaaatcacacaattccatggaaactaagcaacttgctcctaaatgacttttgggtaatgtattagcccattcttgcattgctataaagaaatatctaagactgggtaatttttaagaagaaaggttttattggcttatggttctgcaggctgtacattgcttctggggaggcctcagggaacttttactcatggcagaagacaaagctggagcaggcaggtcacacggaaagagcacaagcttggtgctgggagcagggggaggtgccacacgcttttaaatgacaagatcttgtgagaactaactcattattgcaagaatagtagtaccaaggggatggtactaaaccattcatgagaaattcactctcatgatttaatcacccccaccaggccccacattcaacactggggggatgacaattgaacatgagatttaagtggggacacaaatccaaaccatatcaggtaaacaacaaaattaaagcagaaatcaaaagattctttgaaatagatgaaaacagtgacacaacatagcaacatctctggggtgcagcaaaagcagtgttgagaggaaagtttttagcactaaatgcctacaccaagaagctagaaagatctcaaattaacgctctaacattgcacctagaggaactagagaaacagaaacaaactaaccccaaagctagcagaagaaaagaaataactaaaatcagagcggaactaaatgatattgagaccgcaaaaatccatacaaaggatcaatgaagccaaaagttgattttttgaaaggataaacaagactgacagaccactagcaagattaataatgaaaaagagagaagacccaaataagcacaatcagaaataataaaggtgaaattacaaccaatcccacagaaatacatatgatcctcagagattattatgaacacctctaaatacacaaactagaaaatctagaggaaactgataaattcctagaaacaaaacaccatccaagatttattcagaaggaaatcaagactctgaacagaccaataatgagcttcaaaattgaatcagcatttagaaaaacctaccaaccaatgaaatggttggttttatttgaccctagaccagatggatttacagccaaattctattagatgtacaaagaatagctggtaccaatcctactgaaactattccaaaaaattgatgagagactcctccctaactcattctatatagtcagtatcatactgataccaaaacctggcaaagacacaatgaaaaaagaaaattacaggccaatatccctaatgaacattgacacaaaaatcctcaacaaaatactagcaaatcaaatacagcacacatcaaagattaattcaccaggatcaactagactttattcctgggatgcaaggttggttcagcacacaccaaccaataaatgttactcaccaaataaatagaatagaattaaacataaaaaacatatgatcatctcgattgatgcagaaaaagcttttgataaaatccaacattgtttcataatttaaaaccttcaataaactaggcatcggaggaatatgtctcaaaataataaagccatctatgataaacccacagccaacatcatcctgaatgggcaaaagccgaaagcattctccttaagaactggaacaagactagtatggccattctcaccactcctatttaacatagtattgaagtcctagccagagcaatcagacaagagaaagaaataaaaggcatccaaataggaaaataagtcaaattatctctctttgccaactatatgattctacacatagaaaaccctaaagactgccaaaaggctcttagaagattttaaaatacaaaatcaatgtacaaaaatcagttgcatttctatacattgataatgtttaagctgacagccaaatcaagaacacaattccatttacaatagccacaaaaagaataaaatacctaggaatagatctaactaaggaggtgaatggtttctacaaggagaactacaaaactgctgaaagaaatcataaatgacacaaacaaatggaaaaacattctatgctcacagatttaaagagtcaagatgaccatactgccaaaagcaatatacagattcaatgctattcccataaactacaaattttatttttcacagaattagataaaactattctgaaattcatctggaaccaaaaaagagcccaagtagccaaagcaatcctgagcaaaaagaaaaaaggtggaggtatcacattacctgacttcaaactacactacaaggttacagtaacaaaaacagcatggtattggtacaaaaacagactcatagacccatggtacaagaacagagaacacaagaaataaagccacacacactacaataccaacaggatcatttgacaaaagattgacaaaattaaggaatgggcaatacggactccctagttcaataatataacgaggttgcatgggactaatctggctatgcaacactactgcaagatagaagtcaatacctggacctccaatacctgagtcacctacgtagtacgacacaccttcaccttccagacttggactttaagcttgtgtaaatccgctaggaacacatgaacacgtactatacaatagtcataagtaatgaaacaccagagggtcaactaccaattccgtagtgcaagttggtccatggacacaaagaaagtgtactgaccttaacgccacttcttaaacgcaatacctactaactgggtcacctgcacacttgtacatagtgagacaactaagttaattgatgcgtcggcacaagcataaactatacgtatcagacagaatccacacaacatacctacagaatgggagaaaatattcacaaacgatgcatccaacaaagatctaatatccagaatgtataaggaacttgaataattcaacaagcaaaagaactaaataaccccattaaaaagtaggcaaaagacatgaacagacacttctcaaaagaagacatacaagtggccaccaaacatgaaaaaatgctcaacatcactaatcagagaaatgcgaatcaaaaccacaaagagctaccatctcacaccagtcagaacggctattataaaaaagtaaaaaaacaaaacaaaacaaaacaaaaaacgggtattggcaaggctgtggagaaaaggggatacttatacactgttggtggaaatgtaaattagttcagtcactgtggaaagcagtttgtaaatttctcaaaaaaataaaaatagaactaccattcgagtcagcaatcccactactgggtatataccagaggaaaataaatcattctaccaaaaagacacatgcatgcatatgttcaacacagcactgttcacaatagcaaagacatgaaatcaacctagatgtccatcagttgtgaattggattttaaaaaagtggtacatataccacatggaatactatgcggccataaaaagaatgaaatcatattctttgcagcaacatggatgcagctggaggctattatcctcagcaaattaactcaaaaactgaaaaccaaataccacatattctcactgataagtgggagctaaacattgggtactcatggacataaagatgggaacagtagacactgggaactactagacgggggaggaaggggagcaagggttgaaaaaccacccattgggtactaagatcgttacctgggttatgggatcgttcataccctaaacctcagcctcataataatatacccatgtaacaaacctgcacatgtaccccctaaatttaaaagttggaaattaaataaataaataaaaacctctttgagactcactctcatctgtaaaatggggattataatacctacgaagcatggatgttgtaacaactcaaagaaacaaggaaggcaaaatgattagcacattgccaggcacaaagtaaacaatgattattattattttgcttcatgatcccttactatgtgtatgcagaatatgctaatgtgctagagaaaatatctgatagaaagctgtggaatgttgggcaaatcttctcttttcagtgggtctcattttattcatctgtaaaatgagagaactgaaaatctctgtatgacaatccctgccaacaagtcaccctatttacacactatgatgttcatatttaaaattactatttaattgggtatggcctcatcagcatatttgggagctacagctattttaatccagcatgagaaaaattactaaaagtcagcactaaaaggagtttagcagtggttttcaaatatttcttatcctctgaacctttcgaattaaatcacaaaaagaacaaagtatttaaaataaatcagggttattcttacatagctcagaaaaaatacacacatccctcaaacatatatgtatggggatataaatatatatgtacattacggtggctcacgcctataatcccagcactttgagaggccgaggtgggcagatcacctgaggtcaggaattcgagaccagcctggacaacgtggtgaaaccctgtctctactaaaaatacaaaaattcgccaggtgtggtggtacacatctgtaatcccatctacttagtaggctgaggcaagagaatcgcttgaacctgggagatggaggttgcagtgagccgaaatcgcaccactgcacttcagcttgggtgatagagtaagactctgtctcaaaaaaaaaaaaaaaaaaaatatatatatatatatatatttacacacacactcatatatatatacacacattaaaatacacacatgcagagcgagaaggagaatataataaagcaaatgtgctaatctttggggaactggcaaaaagcatatggaaattcttcgtactattcttccaacatttctgtaagtctgaaatatttcaaaataaagtgatcataattttatcctcaatttgaagtggtgcccacacccatgcacagataatgaagccaagggctaaaagtgacatgattgtccaagagcatgtgttaaattccaaagccagggcttgcacctgcacccaccagctcccagaccaattcatttcccactcaaattcttcccctgttgctctttttaaacagttttccttttagttctcttttaacaagactgaattattgggagctgatgctcccacattaccacactggaacacagaatcacagatcatgaacagctggggctggaataaaggatgagcaattggagctttttctagacaaccatctcaaaccacaaataaggaaacaggtttcttcagttctggttccagtacagtatctactccttttccatcctttgttcaggagctgctatatattctgatacatatgatactttctttttaacaccccaagcaaaaggaatccaaaattatatttcagcccgcacacctgcattactgcgggtcaccttacacccgaaattgggatggtgctcttcctggtggactgagcgtagaaacagaactcctgcaaagacaccagcttgtacattctaattgccattttccataacaaaaattataataatgatgatagtccttacccatgggacgcaaagctactcggaggcagaggtagagggtgattcctgttaactcaaggggcaatggttgctgcgtcagttaatccaacgactgtccatgtataattttttcttttgagacaggtctcactctgtcacccaggctgaagtgcagtggtgcgactttggcttactatagcctcaacctcctgggctcaagcgatcctcccacctcagcctcctgagtagctgggactacaggcacatgccaccatgcttggctaattcttataatattttgtagggatggggtttcactacattgcccaggctgttctcaaactcctggactcaagcgatcctcccaccttggcctcccaaagcactgagattatagacatgaaccactgtgcccggccacatgtaataattttagttaaatctggaggccacagataatttgacttttttttttttttttttttttttgagttggagttttgctcttgttgcccaggctggagtgggatggcgtgatctcagctcactgcaacttctgcctcccggattcaagcgattctcccgcctcagcctccccagtagctgggactacaggcatgcaccaccatggttggctaattttgtatttttagtagagacggggtttcaccatgttggccctggttttgaacacccaccttggcctcccaaagtgctgggattacaggcatgagccactgcgccctacccacttgacattcttaccacttctcagtaagtcaggcaagatgtgggaatatttgagaagggtggtgagtggaatatcactatagagtggctagcagcttcttctgccttttgctcaccttcttgactttccaaaagcactcacgttctcaggcacataaaccctttttgttccgctccccgctttgtgctcttatgttaacatcctcactgggaatgggctccatgtgtatgcatggggtgaatacaacagagagtgtctggaccttaaaggcagaggtgggaagttttaagtgtgagcttcagctgagagctgtctacatggagccaggagctggtataacgatcatgtgcagtatcgggaatgaaagtgctttataaactccacaaacgagattgggtggtaattgctattaattttaccaggcctacagagaagtccatgtggactgatgctgctctgtccagagtgcttatggcacacaattcacatcactaacagtgatggtgggtcacagagaactcagatgaaaggagaggtggcctagctgagcccttacagaatacttaagagtgtgacttctgaagtcagtgggagttgggtccaagttcatgttcctcacttgctagcttcaagaacttgggaatattgcttaacctatcaaaggctcagcttccttacctgtaaaatgggataacagtgcctgtttcctagggttgtagtcaaacaatataaatccaagtgcagaccttagcacagtgcttgtcacatagaagagactcactaagttattatcttccccttggaaatgcaatcccattcatgtttatcccattcatatttaatcccattcatatttaatcccattcatatttaaagaaaatttttattttctttaaataaaaaatctaaaacaacatacttcttttttcttgtgtgtgacccctaattaatatttggctactgtaagtcaatggccctaaagaacagaaatctacattcttgatctaatttataaagaataaagacttagaaaaatataatggggtaacttggatttcgctttctgagtagtttatacccatcattaataataataagagaaggccgggcatggtggctcatgcctgtaatcccagcactttggcaggccgagacgggtggatcacaaggtcaggagttcgagaccagcctggccaatatggtgaaaccccatctctactaaattagtcgggcatggtggtgcacacatgcagtcccagctacttgggaggttgaggcagaagaaatgcttgaacccgggaggtggaggttgctgtgagccaagattgtgccaaaatatatatatatgtatgataataataataatagtaagaagaagaaggaggaagaataagtccaggtacagtggctcacgcctgtaatcccagcactttgggaggccacggtgagcaggtcccttgaggtcaggagtacgagaccagcctgggcaacatggtgagatcccatctctagtaaaaatacaaaaattaaccagccatgttggtgcacacctgtaatcccagctactaagaaggctgaggcatgagaattgcttgaactcgggaggtggaggttgcagtgagcccagattgtgccactgcactccagtttgagtgacagagcaagactctgtctcaaaaataataataataataaataagaaagaataacagtaagtattcactgagtgtttcctatgtcataattggtttccaagcatgacctcatccttatcacagcccatctaccattatgtcttgaagacagagtaccaggtacaaggaatcctgacatgatttggccacaatccctagcttcatggaaacactgatgcacacacaccaactcacattccatgtgagagtctctgtgacatggatgaggactggtgttatagaaactcaaaaggggaggtggctccaagatggctgaatagcaacagctccagtctacagctcccagcatgagtgacgcagaagacaggttatttctgcatttccaactgaggtaccaggttcatctcactggggcttgtcagacagtaggtgcaggacagtggctgcagcccactgagcataagccaaagcagggtgaggcatcacctcacccgggaagcgcaaggggtcagggaattccctttcctagccaagggaagctgtgacagacggcacctggaaaattgggtcactcccaccctaatactgcacttttccaatggtcttagcaaacagcataccaggagattatatccggcgcctggctcagagggtcccacgcccacagagcctcactcattgctagcacagcagtctgagatcgaagtgcaaggtggcagtgaggctgtgggaggggtgccaaccattgctcaggcttgagtaggtaaacaaagcggccaggaagcttgaatggtgtggagcccaccgcagctcaaggaggcctgcctgcctctgtagactccatccacctctggaggcagggcatagccaaacaaaaggcagcagaaacctctgcagacttaaatgtccctgtctgacagctttgaagagagtagtggttctcctagcacgcagctggagatctgagaacagacagactgcctcctcaagcgggtccctgacccccgagtagcctaacttggaggcaccccccagtaggggcagactgacacttcacacgcctgggtacccctctgagacgaagcttccagaggaacgatcaggcagcaacatttcctattcagcaatatctgctgttctgcagcctccgctgctgatacccaggcaaacagggtctggagtggacctgcagtaaactccaacagacctgcaaatgagggtcctgactgttagaaggaaagctaacaaacagaaaggacagccacaccaaaaccccatctgtacatcaccatcatcaaagaccaaaggtagataaaaccacaaagatgggaaaaaacagagcagaaaagctgaaaattctaaaaatcagagagcctctccctctccaaaggagtgcagctcctcgccagcaatggaacaaagctggacggagaatgactttgacgagttgagggaagaaggcttcagatgatcaaacttctccgagctaaaggggtaagttcaaacccatcacaaagaagctaaaaaccttggaaaaagattagacaaatggctaactagaataaccagtgtagagaagtccttaaatgacctgatggagctgaaaaccatggcatgagaactacgtgatgaatgcacaagcttcagtagctgattcaatcaactggaagaaagggtatcagtgactgaagatcaaatgaatgaaatgaagcgagaagagaagtttagagaaaaaagagtaaaaggaaacaaacaaaacctccaagaaatatgggactatgtgaaaagaccaaatctacgtctgattggcgtacctgaaagtgatggggagaatggaaccaagttggaaaatactctgtaggatattatccaggagaacttccccaacctagcaaggcaggccaacattcaaattcaggaaatacagtgaatgccacaaagatactcctcgagaagaacaactccaagacacataattgtcagattcaccaaagttgaaatgaaggaaaaaatgttaagggcagccagagagaaaggtcgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagatttagtcatcaccaggcctgccctaaaagagctcctgaaggaaggactcaacatggaaaggaacaactggtaccagccactgcaaaaacatgacaaattgtaaagaccattgatgctacgaagaaactgcatcaactgacgagcaaaataaccagctaacatcataatgacaggatcaaattcacacataacactattaaccctaaatgtaaatgggctaaatactccaattaaaagacacagactggcaaattggataaagagtcaagacccatcagtgtgctgtattcaggagacccatctcatgtgcagacacacacataggctcaaaataaagggatggaggaagaactaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatacatatgcacccaatacaggagcacccagattcataaagcaagtccttagagacctacaaagagacttagactcccacacaagaataatgggagactttaataccccactgtcaacattagacagatcaatgagacagaaagttaacaaggatatccaggaattgaactcagctctgcaccaagctgacctaatagacatctacagaactctccaccccaaatcaacagaatatacattcttctcagcaccacatcgcacttattccaaaattgaccacatagttggaagtaaagcactcctcagcaaatgtaaaagaacagaaattataacaaactgtctctcagaccacagtgcaatcaaactagaactcgggattaagaaacacactcaaaaccactcaactacatggaaactgaacaacctgctcctgaatgactactgggtacataacgaaatgaaggcagaaataaacatgttctttgaaaccaatgagaacaaagacacaacataccaaaatctctgggacacatttaaggcagagtgtagagggaaatttatagcactaaatgcccacaaaagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaatccttcaaaaaaatcaatgaatccaggaactggttttttgaaaagatcagcaaaattgatagactgctagcaagactaataaagatgaaaaggagaagaagcaaatagatgcaataaaaaatgataaaggggatatcaccaccaatcccacagaaatacaactaccatcagagaatagtataaacacctctacgcaaataaactagaaaatctagaagaaatggatacattcttggacacacacaccctcccaatactaaaccaggaagattttgaatccctgaatagaccaataacaggctctgaaattgaggcaataattaatagcctaccaagcaaaaaaagtacaggaccagaccgattcacagctgaattctaccagaagtacaacaaggagctggtaccattccttctgaaactattccaatcaatagaaaaagagggaatcctccctgactcattttatgaggccagcatcatcttgataccaaagccgggcagagacacaacaaaaaaagaaaattttagaccaatatccctgatgaacattgatgcaaaaatcctcaataaaatactggcaaactgaatccagcagcacatcaaaaagcttatccaccatgatcaagtgggcttcatccctgggatgcaaggctggttcaacaaacacaaatcaataaacgtaatccagcaaataaacagaaccaaagacaaaaaccacatgatatctcaatagatgcagaaaaggcctttgacaaaattcaacagcccttcatgctaaacaacctctcaataaattcggtattgatgggacgtatctcaaaataataagagctatttatgacaaacccacagccaatatcattctgaatgggcaaaaactggaagcattccctttgaaaactggcacaagacagggatactctctctcaccactcctattcaacatagtgttggaagttctggccagcggcaatcaggcaggagacaagaaataaagggtattcaacttagcaaaagaggaagtctaattgtccctgtttgtcagatgacatgattgtgtatttagtataccccatcatctcagcccaaaatctcaagctgataagcaacttcagcataagtctcaggataataaatctaatggctgctaaaaatcagaagcattcttatacacctatattaacagaccagagagccaaatcatgagtgaactcccattcacaattgcttcaaacgagcaattatatacctaggaatccaatcttaacataggagatgtgaaggacctcgttcaaggagatctacaaaccactgctcaacaatattaagaggactcatacgaatggaagaacattccatgctcatggataggaagaatcaatattgtgaaaatggccatactgcccaaggtaatttatagattcagtgccatccccgtcaagctaccaatgactttcttcacagaattggaaaaaaacgactttaaagttcatatgggaacaaaaaagagcctgcattgccaagacaatcctaagccaaaagaacaaagctggaggcatcatgctacctgacttcaaactatattacaaggctacagtaaccaaaacaacatggtactggtagcaaaacagagatatagaccaatggaacagaacagagccctgagtaataataccacacatctacaaccatctgatctttgacaaacctgacaaaaacaagaaatggggaaaggattccctgtttaataaatggtgctgggaaaactggctagccatatgtagaaagctgaaactggatcccttccttacaccttatacaaaaattaattcaagatggactaaagacttaaatgttagacgtaaaaccataaaaaccctagaagaaaacctaggcaataccattcaggacagaggcatggctaaggacttcatgtctaaaacaccaaaagcaatggcaacaaaagccaaaattgacaaatgggatctgattaaactaaagagcttctgcacagcaaaagaaactaccgtcagagtgatcaggcaacctacagaatgggagaaaaattttgcaatctactcatctgacaaagggctaatatccagaacctacaaagaactcaaatttacaagaaaaaaacaaacaaccccatcaacaaatgggtgaaggatatgaacagacacttctcaaaagaaggagtttctgcagccaacagacacatgaaaaaatgctcatcatcactggccatcagagaaatgcaaatcaaaaccacaatgagataccatctcacatcagttagaatggcgatcattaaaaagtcaggaaacaacacgtgctggagaggatgtggagaaataggaacacttttacactgttggtgggactgtaaactagttcaaccattgtggaagacagtgtggcaattcctcaaggatctagaactagaaataccatttgatccagccatcccattactgggtataatacccaaaggattataaatcatgctgctataaagacacatgcacatgtatgtttattgcggcactattcacaataccaaagacttggaaccaacccaaatgtccatcagtgatagactggattaagaaaatgtggcacatatacaccatggcatactatgcagccataaaaaaggatgagttcatgtcctttgtagggacatggatgaagctggaaaccattattctcagcaaactattgcaaggacaaaaaaccaaacaccgcatgttctcactcaatggtgggaattgaacaataagaacacttggacacaggaaggggagcatcacacaccagggtgttgaggggtcgggggaggggggagggatagcattaggagatatacctaatgtaaatgacgagttaatgggtgcagcacaccaacatcgcacatgtatacatacgtaacaaacctgcacattgtgcacatgtaccctagaacttaaagtataatttaaaaaaaaattaaaagaaaaagaaactcaaaaggaggattaattattaccagggacgggaggcattataggagcctcaggaacttgaacaataaacagaaatatcacagattacaaagggagggaaagagccttcttagcagagggaacagcacatggaaaggcatgaagtttgaaggtgtattgcatgcttcagacattctctggaatggttacaacatcaggcacaggaaggtggagacagagggaggaacaatactctcagcattgtaaccaggccagacagttagaaccaccggacctgaaatactatggactttgaatcccaggctcaagtttgtaactctttcctgtaggcgatgagatatgattaaaggctttttaagtattggagtaacatggcactaatgtttcctctgccttatgtcccttaaaagcagtggggttttttttctatttttgataaaaattagttccaagtggttagtgttttatgattgtagactttcagagaccatcagatccagcccctaccttctagcaggtaaagagtatatctgcattttatagatgaggcatataaagttcagggaagtaaagtgacctaaatacttagaggtagaggccgagttatttcaggtcccctaaatttcaattttttagtttttccagtataaacatcacacactctctgatctcacgtgaattcaattaggaaagtgttgacgaaaagagtcaaactgtaaaatatttgaagagatttattctgagccaaatactagtgacggtggcccatgacacaaccctcaagagacactgaggacatgtgtccaaggtggttgagccacaactaggttttatacattttctgggttaagactgtggagaccaaagttcttttttttttttttttttcttttgagatggagttttactcttgttgcccaggctggaatgcaatgttgccatctaggcttaccacaagctccacctcccagattcaagcgattctcctgcctcagcctcccaagtagctgggattaccggcatgcgccaacacgcctggctaattttgtatttttagtagagagggggtttttccatgttggaccgtctggtcttgaattcccgacctcaggtgatccgcccacctcggcctcccacagtgcttggattacagccatgagccaccgccaagaccaaggttcttatcatgcagatgaagcctcctccaggtagcaagcttcagagagaatagattgtaaatgtttcttatcagacttaaaaagaggccagacttagttgaatctctcctggatctgaagaaaaaggcctagaaagggaagggggttctctacagaatgtagacttttttcccctgcaagaaacaactttgcagggctatttcaagatatgcaaataaatatatttggggttacgatattttgatctccttgcctgttatgtgatgtcatgccagtgtcaggtccaaaagcaagccacattatataaggttaaataaaacccttctagtgagactttatgctctgtagggcatggcttcccaggtcccttaaataggaatttgcgcaagagaagaaaaaaggtaagagtttagttctcaaaaagacaaagagtccttaaatggcagacaagctgggcatggtggcacatgcctgtattcccagctacttgggaggctgaggtgggaggatcacttgagcccaagagttcaaggctacagagagctaggattgtgccactacactccagccctgggaatagagtgaaatcctgtctcaataaataaataaatagcacaggcagtttcacccaccaccccactcattgaagagatgtctgtgcaggagttgagatggagaacatgaatccaccatcttctctgtaggtcttggcaccttcatgcccttcatagagagtgagactcttgccacttgagtgagactccagtgcctaaagacatgtttgcaattgtttctactagatagcctcttggcaccttgctatgttctctagcaattagggggttattggaagcaattttaactattcccaatttctgtctcatgctctggcctgaatgatctcccgactaacccccatgggtcctccagagcctgctggtgtctgtgcgtggatctttcctgatcccctctgccttgcacaggttgtaccagtctgttgagctcctctacttgggtggcatctgccttacctaccccctgcagttctatgtctctgccaagatcattgtgcctgtcatctgtttcctgggtgtgcaagtgctgaaccctcatggtagacttgggcattggctctgccatgctttgtaaacatgtgagtaaaaggcgatttgcttcttttctgtccctccaccaggccccaggagtttacaggagttgggccaccaggacctccctagagcaagtgcaacattccaggcttagtaaatgtttgtggaattaagctgaacctaagagaagcacattggttaggttctttggaggcaaacaacagaatataactctggacaacttaaattaaaacaaatggatttgaacatgcctcacagagtcaagggaaagctaaagaagcagacattgagaaagacagggaccgggcagagcctgagactgaagtcagtgggactgtgcctctgggatgaatttccaccaattgttttctgttcttgagtgcaatgctcaagacgcaaattctatggagagagtgtccaattgcacaagcccatctgttgggcaaggaaagtcagggctttttgattgacagtgccaccaagacacccatgcagtgagagggatggtatctcaaagcaaaaatgggttctacaccaagaatggggaattgatgagtgttaaaagcaacagatgtccacacaagtggacatcacatgacagaagtcaccaggtaagggtaactgtgaaaaacaggatggatatgacattaaccaagttagagaaatggtcagagttattatcttcaaatactaaaagtagttaaagctctggatcaggaggaaactaagttcaaattaaagtttgtatctctcaaacttctcactcagtagtgcttattccaacctcagagtataagccattccacacttgccatttatagacatgaagccagcttggtgaacagccagtaggggaccctgaagatctgacaacaaaatataaagccaaaaagatacagaaggggccgggtgcggtggctcatgcctgtaatctcagcactttgggaggctgaggcaggtggatcacgaggtcaggagtttgagaccagcctggccaacatagtgaaacccccatctctactaaaaatacaaaaaaaaaaagttagcgagacgtggtggcgggcgcctataatcacagccactcggcagggtaaggcaggagaatcacttgaacctgggaggcggaggttgcagtgggctgtgatcgcgccattgcactccagcccgggagacagtgcaagactctgtctcaaaaaaaaaaaaaaaaagatacagaaggaaacctctgttcttaaaaggtttcatattagaacctgaacaatgacccataaacttcctagaattgtgtgcaaaaatggtatgtaaaggtagttgttgctgtttgtttggtttggtttttgtctctttttttattgttttgttttattgttttttttattggggtgttgccctaagattccctagttctccccattttggcaaaaggggctgtgaaaggttttgcacttctgccaacaaagagctgccctctcagatggtctcagtcagaatctgcttcctcagagctacctggccccatcctggccactattactaccagagacaaggatgaaaatgtaaatcatttctcaatttggaaaatgagaatttgttggaagccctctaaggcatttccaatttggatggcgattctgggttttttccccttggaaattcctaggagccccacagtctgctcaaagaacaaggtttaaaaatgtgactttctctccctgcctgacatggccaggtgggaagggtaagtgagtgactgagcaggggccatgcccagaaaacagcacatggcttagtctaaagttacccatctccagctagagagggtccatgctgggtcatttccaagtctcaaagaagccaggaattttggttttgtgtatgtctgtgcaacttttccagtttttaaatagtggcagctaattcaaaaagcgtggtactcaggtggccaatttgcaaccaggacctagattttattcccaaggtatttatgaaggcctttaagcaccctcctgcccctctttctctctgtctctctctctctctctcacacacacacacacacacacacacactctctctctctctctcacacacccacacacacacacatacacacctcacttaaaataaaattgcctaataaaacaagtttctttctgcatctttttgactttatattttgttactggaagatcttcagggtcccctactggctgttcagcaaaatggcttcatgtctgtaaatggtgagcgtggaatggcttatactgtgaggttggaataagcactaatgagtgagaggtttgagggttgcatattttaagctcaacataacaaagagcttttttatactgggtgagaagagtatagtgagtgcccgatctccgaaggtatttaagcagaggcaggacaaccactttccaagagaggaatagttttgctatataacctatgagaagctccttccaagtctgagattctcttctttggttttctttataagtgaaaatcaaaaatgagtgattaaattactgaatctgaaggatgatgcttttgagctattgtctgatgcattgtaaactgcagattatagaaggcatgaaacatatatgtttgccttgaaaatattcactctagatgtgtaaactgctagctctcatttgttttaaatatacaacccatagatttctcttccggcattgtttcttcctggctcacacctaatatgtaagaactgttttggaggcaccctgagtcagacctctcaggcaagtaactaataattcatggagcacagataaggaaactgaaagtgcttctagagccaacacccggaaaggagaggatacatgttggatctcccagaaagttagtttcagagcaaggactagaacacaggtctcctgatgcccaatctagggtgcaacatgttatgcagctcatactaggagattttttttttggaagatacaaacattttagagagaataatttgaagaatttcagaaatgaagacatttgccttcatggcatagggttcttttttttttgtcacaaaacactatgattttattagcaaccacatatgtatcattttccactacgttttacaatggacttgtttcacagagaaggtgaactaattctaatgaaataccaataacgtaccttaaacaagtaacatgttgctgaaaaaaatttaagttaaaggctgggtgcggtggctcacgcctgtaatctcagcaccttgggaggccgaggcgggcagatcacctgaggtcaggagtttgagaccagcctggccaacatggtgaaaccccgtctctactaataatacaaaaattagccaggcgtgatgccaggtgcctgtaattccagctacttggaaggctgaggcaggagaattgcttgaacctgggaggtggaggttgcagtgagccgagatggtgccactgcactccagtctgggcgacagagcgagtctctgtctccaaaaaaaaaaaaaaaaaatttaagttaaaatgcactacattatgtagtgcagaaaaaaaagtgcagctggcaatttaagacatgataacaatgctgaatcagtagtgtttggagtgatatattttgcccatctttggccaatcctagagtagtactcatcacaagctgtatgacaaatgtgaacatcataagctgtacgacaaatgtgaactaatgaggctacaatactgcagaccaaatagaaccattctagagtcagtttcacaatgaaatactccacccccggcctggaaacagtgatctgctgtcgttgctatcctgctgtggcacctatccctgctgccgtatttattaccagatcaggtgtcctccagccagccagcttccaggacaagtggtgcccagtgagtcacaacccaaagaggaacagctgcaggttaccgatttgtattcctgtacatactcaacttgggtggcaaggatttgctcatttaacttgaatatatttacttctaaaaagactgtgggccgggtgcggtggctcactcctgtaatcccagcactttgggaggccgaggtgggtggatcacgaggtcaggagattgagaccatcctggctttaatgctgttttcagatatccccattcctagttttagaggcagccatggaatatatagtctcctctggccttggggtcaggaagaaagggaaatctattcataaaaggaatttaaattctggccttggcctctcaaacatgcttcaagtgaaagatggctcaactaacaggttcctccaggcaaaattattctggtaccaatgactcactcatgttgtcactcacggccataaagagaatggttaaagcaacctaggttttctgagaatcagatttggcgcaatgagttggggtactatgtgccacaattgatttctttaacacaggctcaagcacatgtgcccacatgcacactatggttacacaccagggcagaaccttcttaacaagagagtctccagcacatctttccaagatgctaagttggtggggaaaacacactttgcactcatttggctgatgacctaagcagggtctgggaaaaatgcatttaaccccatctttgattccttgcttctatgctagaagactaacacatctatccctactgagcaaggagcttgcctggagtcagggcattctcatcaaaaggcatctttgatatttttgagctggcgcatggccagatctacagggaggctgaacttgaggctgctgaggcgactgtgcaggttgagggcactctcaaagcctgtgtgtgctatgtagctcccaggctggtagtgagtctcgatgagtgacccgcacttgcagatgaggttcacccaggacatcagacgctgctcattcagtgccatgcacaccaaagccttcaattcagagtctgcactgtgcttgaaagggtcgtgctctgtcagcaccatgtggatgactgtcagtaggctctctttgggggttacatcagtgcctcctgtaacaggaagggcaaagactgggagagctcccgggctgggcataagcactgccatttttagcatggtagtactgtaaccccccaaggggttcaccttgctgactgcctagacagagcagattcatcaagacaagggaattgcgacagagaaagagtaattcacacaaagctggctttgcgggagaccagtcttattattactcaaatcggtctccccaggcatttaggggcagtttttaaggataacatggtgggtagggggcggggccagtgagccaggagtgctgattggtcagggttgaaatcacagggagtcaaagctgtcttcttgcactgagtcagttcctgggtgggggccacaagatcagacaagccagtttatcaatctgggtggtgccagctgatctgtcaagtgcagggcccacaaaatatcgcaagaactgatcttaggaccagtttatggagggtcagaatcttgtagcctccaggtgcatgactcttaaaccataatttctaatcctgtggctagtctagtccccagataagaaggaggtctgctttgggaaagggctgttaccatctttgtttaaactataaactgcaaactaagtttcttccatagttagttcagcttgtgcccaggaatgaacaaagatggcttgggggttagaagcaagatggagtcagttaaattagatctctttcactgtctcagtcataattttacaaaggcggtttcagtactttacaaagagctcccaggggtgcatgggctcaggggctgaggagaaggctggcagcaaatgagcaataggagccatgatgaggctcattcctgaggaggaggcatatagtccatgggctagcaggtccctcacagccaccatcagctccttccacacagccatggccagctcatccttgcctgccagagagaggtcctggaggatggcagaggtggtgacatggtcgtgtggctggtgcctcaaggctagctgcttctctctgtccactgacacctcccgcctcttcaacaagagagcatagtctgtcagcctggcccctctgttatagggttggagggatctggcctgtcacacaaccaaattagctaacagcaaaatctggagcattgccaatgcttgcggcatcaggtgcagccccgtcccttggactttcttcacatcccttgcctttgttttgctgtgtcctggaggcagtgggtctgctgctgccagttctggtggaaccatttcctgtcttcccagaggccttgcgctcacaatgtccaccatctgtctgcaaggggcttcccacttcatcttggatgaggtcgatggacatctagaggtctccgatctgagttttcagttgctcaaccaactgatctttgactagggctgggttgacgatgtgagccactactgcatctacaaactgacgaagttcttcagtggacagggaactgatgtcctcattcagacgcatgtccagtttctttattaacttgtctaggatcacccactgtctttccaacacacgaactgccgcagggcatcataactgctcttggataggcacatgtttccaagtcatctagctaggtcttgagctacagtatccattctttctgcttcttcctttgggtttccacacgctcttgtttttcctgctcactctggtcctcgccccacaactgtggccggtctcctggcagctaatttgtatgtttttggtagagagggcgtttcaccacgttggccaagctggtctcgaactccggacctcaggtgatccgcccgccgcagcctcccacctagggttctttttaacatttccttattatccttttaatgtcaataggatctagagtgatgtcctatttttcatttctgatattggtaatctgtgtcttcttgtcttttctttcttgaatagtctggtagattttattgatcttttcaaacaaataattttctggtttattaattttcctgtatcgtttttacactgttttcaattttgtgcattttttcttctttttctccccttcaccttgctttgagttaatttttttttctagttgcttgacatcagagtttagattatcgattagagacctattttcttttctaatataagcacttaatgctataatatttcttgtatgcctgcattaatatagttgctagccacattgagcgcttgaaatgtgactaatctgaattgagacgtgccataagtataaaataaatattagattttaaaactgtagtacaaaacatgtaaaatattttaatagtttttatattgttacacattgaaagagtaatatttggggtatattgtgttaagttaaatataatgttaaaatttaccccagagagggcaagcaggtccctgtggccacaattaaagtgaagagcgccgggcacggtggctcatgcctgtaatcccagcactttgggaggccgaggcgggcagatcaccaaggtcaggagttcgagaccagactgaccaaaatggcaaaaccccatctctactaaaaatacaaaattagctgggtgtggtggcgcatgcctgtaatcccagctacttgggaggctgaggcaggagaatcgcttgaacccgggaggcggaggttgcagtgagccaagatcgtgccattgcactgcagcctgggcaacaagagcaaaactctgtctcaaataaataaatcaataaataagaaaacctataaatttcaattaaagtaggaaaaaaacatcgcctacttggctcataaaatggtatccaggcagtgaggcagcaggagggccaacgttaggctggctcagcaagagacaacacaaagatggagccagagaatggtctgagtctgcaaattctgccaccattgaggagactataggcttaaggacattaccactgccaggctgggggcctgggcttctctccccattctcagctttcctgaccctgtgcaagcacctccccacctgggagaaatttccagggcttgggctttgccaactctgacccaattttgattatttattgtgtaatttattattgttcctgtgaaaaggccacacatctcctctcttcttccgagagatacgggtgtccatccattggctccacggtccagcctgctgggtgagtgcagcatggccctccccttctggccctcaggcccaggtggctgtgtgccagccaagtgacagtggctgctcatggcagtggcagggggtgggtagaggtggcaggtggcccagcaacctccttttcctcaactcctccaaccaccacccacctctcaccctccccggtgtcaagcgtttttatctgtggttggcggtggcagtaatggcagatggtggctgtggtgctggtggcagctactatgagagatgatgaattcctccttcatgatgaaccaggccagcctggaagatggtcaccatgacctcttctgcctggctgactcgacagggattaaatggaaaagatatgtatggcaaggcccaacttctgcccctattatgtttcccacgactcaaggtgaccctaatttgaacagctttaatcgctgccttaagacagatatagctggtgtttggcagcaagatcaaatacctagaagaagagaattgtcaatattttggtggggcaaagaccccaattttgctgaccttatttaccaggatttaacagacgaggaggatggagtatgggagaaaagactttactctgaatgccatactctgcttttcaaagcagttcacagtctgttgggatggtgtttaatgaaccagaactttgtatgtattggcaagtggtttgtacagtctcatgaagaagattaaaaacctataaataaaagtgaatgattgtcctgctctttcacctttttcttgcatggagacatcaatgtttgtaccaatgtggaaattagccaacatcaacctgtataccttcttagtgaagatcacatcacccttgctcaacagcttaatagcccatttccagttatcttaagccaatttggactaaataaagaccccacttaaaagatagagattacgggattgagctttaaaatgaaccaacggtatgccacttataaaaaactcactttactggtaaagacacttagacactgaagattaaaagatggaaaaagatattctacatgaacagaaaccaaaagtgagcaggagtagctatacttgtatcagataaaatagatattaaatcaaaaatagttaaaaaagaagaaaataattacataatggtgaagagatcaattcaagaagagtatatcgcaatttaaatatatatgcatccaacactggagcacccaaatttataaaacaagtattactagacctaaagaaagagacagcaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaagaaagagacagcaatacaataatagtgggggacttcaataccccactcatagcattagacagatcactgagacagaaaatcaacaaagaaacactagactcaaactggactctaggccaaatggaccaaataatatttacagaacattctacccaacaattgcagagtatacattcttatcagcacatggaatattctccaagacatattgtatgttagtccacaaatcagtctcaataaatttttaaaaactgaaaccctatgaagtgtcttctcagaccacagggaaacaaaactagaaatcaataccatgaggaactttcaaaactatccaaatacatgaaaattaaaccatatgtcccttaacgatctttgggtccatgatgaaattaagatggaaatttaaaatttttttggccgggtgcggcggctcatgcctgtaatcccagcactttgggaagccgaggcaggtggatcacctgaagtcaggagttcgagaccagcctgaccaatatgatgaaaccccatctttactaaaaatacaaaaattagccaggtgtggtggcatgtgcctgtaatcccagctactcaggaggctgagacaggagaatcacatgaacctgggaggcagaggttgcagtgagccaagatcacaccattgcactccagcctgggcaacaagagtgaaactccatctcaaaaaaaaaaatttttgaaatgaatgaaatggatatacaacataattctgagatatataaaaaaagtagtgctaagagggacgtttatagagttaaatgcctacatcaaaacaaaatagaaagatcaccaattaacaacttattatcacacctctgggaactagaaaaacaagaacaaacccaacccaaagctaacaaatgaaaagaaataataaagattagagcagaactaaatgaaattgaaaacaaaaaaagataaaaaggatcaacaaaacaaaaagttggttctttgaaaagataagcaaaattgacaaacttctagctagactatttattgatttatctaatcaataactgtgatttatcacataaacagaattaaggacaaaaacaatatgattatcttaatagatgaagaaaaataattttataaaatccagcattccctcatgataaaaaccctcaacagaataggcaaagaaggaacatacctcaaaacaacaagggccgtatacaacaaacccatggccaataccatactgaacagggaaaagtttaaagcaatctccctaagaactggagtaagacaagaatgcccactctcaccattcctattcaacatggtactggaagtccttgccagagcaatcaggcaagaaaaagaaataaaggcatacaactgggaaagggaagttaaagtacctctgtttgatgataatatgatctatgtctagaaaaacctaaaaattcctccaaaaacaaaaaactcttaggtttgattaatgaattcagcaaagttttaggatacaaaatcaatatacaaaaatcagtagcatttctatatgccaataacaatcaagctgagaaccaaatcaagaaggcaatcccatttacattagctacaaaaaataaaatacctaggaatatatttaaccaaggaggtgaaagatctctacaaggaaaactagaaaacacagttgttaaaatgactatactgcccaaagtgatctagagattcaatgcaatccctattaaaattccatgctcattcttcacagaatcagaaaaaaaaaccttaaaatttatatggaacccctcccccaaaagcccaaatagccaaagcatccaaagcaaaaagaatagagctgaaggcaccacattacctgacctcaaattataccgcaaggctatagtaaccaaaacagcatgacactggtatagaaataaacacaaagaccaatggaacagaataaagaacccagaaatagagccacatgtctatagccaaatgatttttgacaaagttgacaaaaacatacactggaaaaaggatacccttttcaataaatgatgctgataaaattggattgccatattcagaggaataaaactggaccccctatctctcaccatatacaaaaatcaactcaagttggattagagacttaaacataagacctgaaactattaaaatgctagaagaaaacccagggaaaacacttctggacattagactaggcgaagaattcatgactaagacctcaaaagtacaggcaacaaaaacaaaaatagacaaatgggacttaattaagctaaaaagctgctgcacagcaaaataataattaacaaagtgaacagacaatctgcaagataggagaaaatatttgcaaactatgcatccaacaggggactgatatccagaatttacaaggaattgaaacaactcaaaaaaaaaaaaaaccccaacattaataactccattagaaagttgccaaatgacatatgtagacatttcttaatatgaaaaaatgttcaacatcactaatcatcagagaaatgcaaattaaaaccacaatgaaatatcacgttacaccagtcagaatggctattattaagaaatcaaaatataacagatgttggcaaggagcagaataaaaggaatgctaatacattgttgtatttgcattagagaatgtaaattactacagcctctatgaaaaagtatggagatttctcaaaaaaactaaaaatagaacaatcatttgatccatccactactggctatctacccagaagaaaagaaattattttatgaaaaatatacctgcactagcatgtttactgcagtgctattcacaatagcaaatatacagaatcaacctaagtgtctgtcaatggatgaatggataaacaaaatgtgatatatatatacacacacacatacacatacacattgaaaggttcttgtatcggttcgaaccccaagagcgcaccaacagacaacacgaggtggtgtggagcaacatgctgttttaatgagctcctgggtgcaggcggcctgaggcctaaaatggcatcagccccaagtgaggacaggacaggggtttcatagtcctctgtaaacaggaagtgtcccagtctgacatgactggtacctagtacccagacggactctttctcgatcttcaggggtacgtgtcttctggccagggtaggtgtcttccggccagggtaggtgtcctccagccagctctcttcctgcttctgctatcttgctgacgcacgctgctggtgcaagggccttgcaccttggactaggcctgagaaggaaggtgttattcatcccttcaagttttcaggccccggggagaatctttcacgcatacatacacaccagcccataggccatagtttgcttgtctctgctttaatcaaatctcttttagagcaatttaaaataaagaagaacaggctgagcacagtggctcatacctgtaatcccagtgctttgagaggcccagggaggaggattgcttgaacccaggagtttgaggttgcagtgagctatgactgtgccactactctcctgagcaacagagcaagaccctgtctctaaaacaatttttttaaaagttaaaaataaggaaaaactatcttttatactttaaccatctccaaagattgtcatttctttttatagatgtaagtttctgtctggaataatatttcttcttcctgaagaatttaacttttatagaacagatctgccagtaattatcttagttttcatttgtttttttaaaaaaaggctttacttctccttcatttttgcaagatattttctctgggttgacaatgtttttgtgtaaacactgacaagctatcacttcaatgtcttctgatttgcataatttctgataactttaattcttatatctgtttctctgtatctaaatgtctttttcccttggctgctttcaaggttttccctttattttttatttacatcagtttgaatatgatgtgtctaggcaggtgtgtgtgtgtgtattgtgttggtccttatcctctttattttggtatttttctctgcactttttttttagacgaggtctcatgatgttgcctgtgctggcctcaaactcctgaactcaaaacatcctcttgccttagcctccaaagtagctgggactacaggcatacaccactgcactcggctctgaactttttgatctatagttttatgtcttttattattttttgaaaatttttggccattatttctttttttcttcaaatatttattttatattttttaatagagatggaggagtctcactgtgtcgcccaggctggtcttgaacttctgaactcaagtgatcctcttacctcatcttctcaaagtcaaatatttcttttgccacattctgtcttcttcatctgggattccaattactcatatgttaaacagtttgacattgtcccacagctcttggatgttctagttttttcactctttttttctgtttatatttcagtttggataatttttattgacctatcatcaagttcacagattatttccttgtcttcattgagtccactgataactttatcaaaagaattcttagtggtggctcatgcctgtaatcccagcactttgggaggccaaggtagaaggactgcttggggccagaagttcaagataagcctgggcaacacagcaggaccccgtctctaaaaatatatatatatgaaaatagatgggcgtggtgacatgcacctgaagtcctagctacttaggaggctaaggcgggaggatcagttgagcccaggagttccaggacgcagtgcattgtaattgtgccactgtactctagcctagggaacaaagtgagaccttgtttctaaaaaaaaaaaaaatttttaatgaattatttgtctctgttactatttttttattactcacatttccatttcactattttgtatgatttccatctctctgatgaattttccatttgttcacacatgctgtccaaattaattttagaaataccatgaagtatcaaaaacagtcatgtccctcaactcccagcatgctgggaaggtgggaagccttcttgggtttgattctgtcttgagagtatagccttttgtagagaaagaccaggacaacaactgagagactctgtgctagagtcccagaatctcagaattctagaagcttgtagttttggaattacggaaactagggttccaaaaaatatttcataagattttagagttgaattttagaggttgaacattgccagagatgggagttcaccaaactcacaaggcagctaaggccaaagggaagctgtcttcctttgggtagaataatgttgttaatgtgctattaaaaggaggccagttcccatccagagtgtaacagtcacaacaaaagcagaatctccctcccctttccctgtctcccgctcccataaacaccagagtgagatagccccaaacctgaaaagaaaaaccaaggaagatcagtacacatttatcccctttaacatgtttgtaatgctattaggtagaaagttttagtttcttccaaaacgaaaaaggaaaatatttttttaaaaaactaaaaactaaaagaagagtgtttttaaaaaaaatcctattcactagccttgttacacatcctttttctaaaatttgcttttccaaatttctgttgatagtgggagttgataacaagatagaatattagaaattcttttaacttcactaagtctcaatgacctcatctctaaagtagaataaatttctgttctgtctccctattaagctttaacatattataatgtgacatcaaaaaaagctaatgagatatcattagtgagaaaggtaggtagtaggacaatattacagtgcaaggttgtttgtaaaagtgaatatgtgtgtgtctagggctagggggataatagttgatctctggctggtagaattatgtatatgtttgttttccatttgcttgtgtacattttctcattttttacaatgaatatagtttatagaaaattaaagtacataagaactccaaagttctatacaaatacaagaaatgattgtcagtggtccatgcaaggtctctagctgaatttatttatttatcttccccttgtatttatgccagtggttctcaatgtccctcctccacccctggaggacatttttcaatgtctggagacactttttgattgttacataagggaggtgtgctactgacgtctagtaagtacaggccaaggatgctgctaaacgttctacaatgcacagaatgataactccacttagaagcaatttattttattattattattattttgagacagagccctgatgcccaatctggagtgtagtactgcgatcttggctcactgcaacctccgtctcccgggtccaagtgattctcctgcctcagcctcccaagtagttgggattacaggcgcctgccatcacgcccggctaatttttgtatttttagtagagatggggtttcaccatgttggccaggctggtctcaaactcctggcctcaacagatccgcccgcctcagcttcccaaagtgctgggattacaggcgtgagctgccgcgcccagcctagaagcaatttaaatcagatagtggtcacaagcaagttgatattgagtaagaaagtacagatttgatattataatttaatgaaaaaatcttataaaatactgaatttgtttccaatattctgctgttacaaacaatgctgcaaagaatattattgtatacacatacttaggaaatgtgggaaggtttcttcaaggtggatatgaggaagtggtgtatctgggccaaagggcatttccatccttagttttagtagtaactgtaaatctaacaacatgaatggagcctaacaaaaaaaaaaaggaagaaacagaatgaaattctaatgtggtatcatttatattcattaagcatatacaacaacaacacaataatatgcagcattgcatgagtacctataagataatatacactaaatacatcagaactgttatctgtggtgggatgatcatatactggcttggcccagactcttggggaaaagctgtctgcctcagatataatctgcttccaatacagaatggtttttatttttagttaacttcagttttaaatttccagtgagttcagagaacatttaggaacaaaggcctttttaaaatgagaaataaggccaggcacagtggctcacgcctgtaatcccaacactttgggaggtcgaggtgggcagatcacttgaggtcaggagttcgagaccagcctggccagcatgggaaaaccccaaccccatctctactgaaaatataaaaattagtcgggcatggtgatacacacctgtagtccctactactccagaggctgaggcatgagaatggcttgaatctgggaggcggaggttgcagtgagctgagatcgcaccactgcattccagcctgggtgacagagggagactctgtctcaaaaaataaaataaaaataaaatgagaaatatgccaggcacagtggcttatgcctgtaatcccaacactttggtaggctgaggtgagaggatggcttgaggccaggagttctagaccaacctgggcaatatagcgagaccctgtatctacaaatatattttaaaattagccagtcatagtggtgtgtgcctgcctgtaggtccagctcttcaagaggctgaagcaggaggatcacttgagcccaagagtttgaagttgcagtgagctgtgaacgtaccactgtgctccagcctgagggagttcagtctggggtgggaacaggtttagtttttaattgttgcatttgacagttcattacttgaccagcttgaatttgaagatctaatgcacgaattgctttcttctcagctgccctttcaggggtgtgtagaggcttagagcacatcacgatttttggacagattaagcaagtcagaggttttcacagtagcccaattgagttgatttcactttactatcatgttcttcttccagtccactgataacagttgaattacaaagggaggttgtgtaatttattttgccaaagccagagtattgccttaaaattttctgtagtctataatgaatttgtagactgggtcatctggttcttaggtgcattgttgtattttgtttttccagtcaatagttttttagaaaacttcagggatttgtttatggagatctttgccaatttttgaacatcagtaagatcagtcactcttctcttagagaaatcatttaaagggttatactagtcagctttttccatccacgtgttagcatgtccttcaccagcaagcatgcgtatcagctggtaaaggttgaaatagccaggctggtagttttggtaaccaagttgaattatttagcaaaggcatttagattttctaaggggccaggggaagtcctttgttgcagctctgggttctgcctttgttcaaggggactaagttcctgaagaggtccttgagagtccttcattagatttaaccttaaatgtggcatggataggacaagtcattagtcacactcttaggatgggaactccccatgattgatcaccaaaacaaagattctttgcaaccagggtcaccagaaaaaaggagaaatctattgtaaaagctggcaacagaggacaacaaaaaaaggcctgaacctcagctagggtaagaaggtggttcaggacacaaaaagacttatccagtgaagtttggggtcattcggagtcaataaaatgcaaggagttcccacagatacttttacttgggtatatggtggcacaggagatcagaagggagtcactttgcatcccacttctgacaacatgtaatgtcaactaagaaataaaactaacactgcagagtggcaaacaaaagaaaacacattttaattagggtcttaggaatgcaattcaagagacacagatctagcaaagcagctaaattatgttccatctaggcaagcttaagcagaggcttataagcgccacagtaagtttacacatcaggaaggttttagcacagtttatgattgatgatggcaggttatcagcgtaggatgtctctagtcaatgatccatccagttttggcacacttgtgattgattatggcaggttattggtgtaggatgtctttagtcaatgatcaatccagttcagtgtagctgaactctccaggaggttggtgatcaggctcaatataaacagctcaaatcaaatgcaggtggttgtataatttggcctagttaaacaggttgaattccatctggatgtgtacataactggggtccaacgcctcctaccctcctgcatcctttttagaaaggacacatgttggatttttcttttaacaccctgccaaaagattctgtccccatagagagttattagcaagacaaggagattcccctcagtgctcctatgaaatgttttcaaatgttctactgttacgggaagtcagggaccctgaacagagggaccggctgaagctgcagcagaggaacataaattgggacaacttcatcttattatggacatttttcagttctcaaataatacttttataattttttatgcctgtctttaataaactcttaatcctgttatctttgtaagctgaggatgtacgtcacctcaggaccactgtgataattgtgttaactgtacaaattgattgtaaaacgtgtgtttgaacaatatgaaatcagtgcaccttgaaaaagaacagaataatagtgatttttatggaacaagggaacacaaccataaggtctgactgcctgcagggtcaggcaaaaagagccatatttttcttcttgcacagagcctataaacggaggtgcaagtaggaaacatatcgctaaattcttttcctagcaaggaatattaatattaataccctggggaaaaaaaaaaaaatgcattcctggggggaggtctataaatggccgctctgggaatgtttgtcttgtgccgttgagataaggactgagataagccctggtctcccgcagaaccctcaggcttactagggttgggaaaacgcagccctggtaaatttgtggtaagaccagttctctgctctcagaccctgttttctgttgtttaagatgtttatcaagacaatacgtgcactgctgaacacagacccttatcagtggttctgcttttgccctttgccctgtgatctttgttggacccttatcagtggttctgcttttgccctttttcctgttccctcagaagcatgtgaactttgttagacccttattagtggttctgctttttgcactttgaagcatgtgatctttgtacctactccttgttcttacaccccctccccttttgaaacccttaataaaaacttgctggtctgagacttaggtgggcatcacggtcttaccgatatgtgatgtcacccctggcagcccagctgtaaaattcctctctttgtactgtctctctttatttctcagccagctgacacttatggaaaatagaactaacctacattgagatactgggggcaggttcccccaatattctgccatgctcggattttaattgtaagtgtgttcccctctggggcaagtggaaaccaggttatcttcttccactgcaggttccctggccatcctcatcccccatctgggcatggtccttacccagatgagcttggtgagcagcagcaccctgcccctcatcatcctgtgcctcctggagatgactacctactactcagagtgcatgagctccctcatcatcaccaaggacgccctgatcagcatcctgggctttgtgggatttttggtggggaccttctaggccctccatgagctgatccagcctcaagacctctcctctttccaaactccactggcaccttgaaacagtgaccaattttcaactcaacatttcccgcttcacttcctaaactgacattctagcattgtttgaacaaagatccttctttaattgctaatgtgtatatttatatggggccaccacagtgttgggtggagagtacaggagtggggtcagaggatctgagttctattcctgagatctaccatttacccccatcagatctgagtgggccacttccccttgggagcctcaacttcacaaattcagttaagttcagcctcacccacctcagaatgttgtcaggaatgtcaggaagagtatgtgcacacatacatttttaaaagctaaggtgctctacaaatgttggtgattttcattattttactgttttctcctatgatgaccagaagaggcatgaacaggacccctttttctccaaaccaggctggactacctcttgtcccaatgtcttgggagctgagaaaatattgatgtgtgatccaggagacctggtaccaccaggaggcaccaccaatggaggcacactgtgggccaggcaacgtacaaaatgcatcccatacgttatgccactaaatcatctgcagaaccctgtaaggtagatgatgtcttctccatttcacagaaaaggacatctaggttccaagaagttagggaactagtgctaactcatacagttagtaaggggtggagtcagatttaaacactggcctatttagtactgaaccccttgttcataaccactaaaccctgtccctgactcagctgcctgattttagacaagtgacttttcctctctgagcctcagtttccctagctgtaaaatgagagggtggactagatgacctctgtggacactttctaaaccatctttgctctccctacttcagaagcttgttaccaagagtttggtttccctgctgattggtggggccaattgtgactttgtctccagcctctgttgccccctgaactggccactttccctgagcctgtcaaataggacaggatttttgatgtgtttgcaattactgggcaccttaaccaggtgaagatgctgtatgagcattaacatcacatctatatgccacaggcaacatcttgattcaataggaagagcactgagcagaggtttatagaaaactagattttagttccaggactacttctagctagctggagacagtggacctccagtaatgtcccatcattgccttcttatcatctttctctttcttctggaaacagtgccctgattttgccttgggcaaccaccctttctccactctctaagttgttttagaggagcagactctaccccaactccaggaagtgagcacatgacctgggtttggcgaataagtacattcaatcctcctgtccataatgctttgttctgagatggccatataatcaagggttcatgagcccttggactttaatcagtgatatcaggaagagggtaatcttaatgctagggttaataaacccagatgaactaacctggaactgaagtaaacatgttcccagactgcacagcagaagcatatatcaagcaggagaaaattatgccaagagatggaagaaaagcctgttggtgtccttggagctcctgcttccactggtgcctgatgcaggtttcaccttgtgctttccagttacatgggtcagttcctttttgcttaagccacattcagttgggtttccaacatttgcaactgaaagaactctgactaaatctctcagtgaccttgagcaagttcatttactccttttaggattagttgcctaatctgaagtgagagtgttgaaactctaagatccttaatagtacaagtattctataatttaatagtataattaaaatgggatctcactagaattactatgatcaaagaggcagacaataccaagatttgatgaggatgtagagaaactggaaccctcatgcattgatgatgaaaatctaaaatgggacaatcactttgaaaagcagtttggcagtttctcaaaaagggaaacatatacagttgacccttgaacaacatgggtttgaactgtgaaggtctatgtatggattttttaaaataaatatattggaatttttggagatttatggccatcttaaaacttgcagatgaaccatgtagcctagaaacattaaaaaattaagaaaagctaggtaggtcatgagtgcataaaatatatacagatattaggttattttatcattcgttgccataaaacacacataaatctattataaaagttaaaatttatcaaaactagcacacacaagtacttacagaccacacacggtgccattcacagtcaagagaaatgtaaacataaagatgcagtattaaatcataactgcataaaattaactatagtacatactatactgttgtaataattttgtggatacatcctgttgccattgtggtgagctcaagtgttgctagtatcagcttataataccatgtgacactaatcatctctgcatgagttcagtagttcatctctccagtaaattgtatgttacagtaaaagtgatctcttgtggttctagtgtatttttcactgtgtttggtgcaatcccataaatcttgaataacaccatgggatccatacaaagtgccactagtgatgctggaagtgctcccaagaagcaaataaaatcatgacattccaagaaaaagttgaattgtttaatatatactatagattaaggtctgcagctctgcttgcctgttaattcaagataaataaatccagcgtaaggactactgtaaaaaaagaaaatgataagctctggggatgatctgattccaaaatggtggtgttgaagcaagctggcttcagtttcccctacagaaaaccaaaaacaaatatagagcaccaagagtatcaccagtgatatcccagaactcaaatatgaggatttaacaactcccagggccacagagaagtgaaaagccatcaagcagacagtaagacaatcagatttccatattcatggcaaccctccttccaatctgcccagcaccaagtgtttgaaaactcagacaaaggagatgtcaaatcagagtggttgttcagcagcaccacactgtaggacatacattccacaattcccctgggcatgaactcctagccagccttcccacactgcgtggctatcccctttgggacctcttccatctgggacaggcagccaaggcaaacctgggcttaatgtgtcatccagtgccaaaacacaggtagtgacctagtagggaaaaaattcaacaggtaaataacaaagaatctctaagcaaacataacaaataaaaactaaaacaaagacagagaagactgaaataaataatcgttccatacaaagacataggtgtacatccacaagaaataacagtacacgggaaccatgacttccccaaacagacaaagcaaggaaccagtgactgatcctagcaagactgtgatatgtgagctctctgataaaacattcaaaagagcacttttaaggaaactcagtgatctccaaaataatgcagaaaagcaattcaggaatttattagagaaatttaacaaagagattgagatatttagaaaaaaacaacaacaaatcttttaactgagaaatacatttgctgagctgaaaaactcatcagagagtctcaacagcagaatcaatcaagcaggggctgggctctgtgcctcacgcctataatcccagcactttgggaggctgaggcagggagatcgcctgaggtcagaaatttgagaccagcacagccaacatggtgaaacctcatctctactaaaaatacaaaaattagcttggcatggtgacatgtgcctatagtcccagctattcgggaggctgaggcaggagaattgcttgaacttaggaggcggaggttgcagtgagctgaggttgccccactgcactccagcctgggaggcagagtgagactccatctcaaaaaaaaaaaaaaaaaaagaagaatcaatcaagcaaaggaagaatcagtaagcttgaagacaaactaaaggaaataatagaagaaggatcaatactatatagaaacagtgagcttggagacaggctatttgaaaacacacagagggggaaaaaaagaaaacagaatgtctacaagatattaaaaaattatctcaaaagaccaaatctaagaagtaatggtgttcaagaggtagttgagcaacagcaaggggtagaaagcttattaaaaaataataacagaaaacttttcaaaagttgaaaaagataaatattcaggtataagaagatcagagaacacaaacagattcaacccaaataaggctacccaggcttatgataatcaaactctcaaaagtcaaggacagagagaggattctaaatgcagcaagagaaaagcaaacaatgtataaaggagcttcagttcatcttgcaacagacttctcaatggaaaccatataggccaggaggcaatgggataacattttcaaagtgctgaaagaaaaaaaaactgtcatccaagaatactacttccagcaatgctatttttcaaatatgaagaagtctttcccagataaacagaagatgatagaatttactaccaccagacccatcttataagaaatactaagcagcttcttcagcatgaaagaaaaaaacactaatatctaaaaagaaaacatttgaagctataaaacctactgataaaagtaagtacccagacaaacccaaaatatttaaatactgtaattgtggtatgcaatccactcataactctagtatgaaattttaaatacaccatctgaaagcagaaggttttgtctgtttaacaagcacttatgttaacaatttgggcagttgcagaacatgattacttcaatttctctcactatttttgactctaaaatatcttatatctgggcactaaaatgttcttctttagtagatattggactgatataagaaatatattatttttaaagcaatataagatgtttcgagttgtttgttcagctcaataaagaatacaatgttgctaataagttaaatgctaattacagttagtaactttcatcatattgtccaattatatcattgtgaaaatgaattcagcctctacaccaggggtctcaacgaactttaaggctcactacacatagtactctatggaaagtattgtcagtgctatggaagagagtgctgatagaatatcatcaaaatgtgaaaagattacaccattgaagatgccattgtggttatagaaaaaaccataaaagcctgaaacaataaatttctgcagaagaaaactgtgcctagatgttgtacataacattactttaatggccaaaaccatgattacttttgcaccaacctaatacaacagagccaatcaaggaaataaaaaaagagattgtggatgtgacaaaaaagatggggagtgaagggtttcaagatatggatcttggagaaattcaagagcaaatagacaccatgccagaggaattaacaaaagatgactggatggagatgagtgcttctcaaccggtgtcagctgaggaggaagaagaagcagcagcagtgtcagaaaactaattggcatttaaaaatctgacagaagggttctggtgattgaagactgcttttgacttccctaacaaaatggacctttctatgatacaggtactgaaactaaagcaaaggacagaagaaagatcaatactatatagaaacattttagagaaatgaaaaagcagaaaaagtcagacagaagttcagtgtatttctgtaaagttacactgagtgtgcctgcctgtcctgcctccccttccacctttttccacccctgccacccctgaaacagcaccattaaccctccttttcctcctcctcctcagcctactcaatatgaagacaatgaagatgaaaattacatgatgacccaactccatttaatgaatagtaaatatattttctcttccttgtgattctcttagtaacattttcttttttctagctcactttattataagaatacagcatatataatacatataacatacaaagtgtgcgttaatcaactgtgtatgttattggtaaggtttccagtaaatagtaaaccattagtaattaagttttggagaagtgaaaagctatacatggattttcaactctccaaggagtctgtgctcctaatccctgcattatctaagaatcaactgttgaggatccaccactttaagcaaaaaattttaaaaaagctttaataaaaataaaattttaaaaagaatcaagtatttgacatacaatggaacaattctacttataggtatttatacaaggcaaatgaaagcataaaacttacgtccacaaaaaacgtgtatgcaaatatttatgacaacatgactcataataggccaaaactaaaaaccgtccagagatccatcaactggtaaatggataaacaaaatgcagcatacccatacaatggaatatcaatcaacaattaaaagaaacaaactattggtttgtttctacagcatggatgaacctcaaaacattctacagcatggatgaactcaaaaacgttatgctaagtgaaagaagccaaatgcaaacaaccacatgttgtgtgaatccatttatatgaaatgtctaaaaaaggcaaatttatagaggcaaagagcacatcagttgctccctagggctggtagggtggcatgactggggatagcaaatgggcaggaggagactattaggtgtgattgaaatgttcaaaactggctcgtggtggtgattgcacaattataaatttactcaagtcatttaattgcacacttgcagtgggtgaattttatggcatgcaaattataataataaggctatttaaataatggaatgtcccctcttagcctcttatttgctagctgaaaatcttttaggagaattagactagaagagaaagagagaagaaaaaatatgcctcctccagaaattgctctgaaaagtttctaactataagctaagcttatgtttttcttgcaattcgatgttgtatcaggagagattcattagagatataggttgagtgggggtagccaggagatttctaaaacatttgtggatgttgtttgaaagttagctgactctggaaggcatggatgtattaggagccaaagaaatgatggttcagacagtttgctatttctctgtgtagaaagatcattgggccaatatgtctgttttatagctttaggattcagtaattcaccatacatgatctcttacatgatgtcattcgaatcattgaggcatttataaaaatgtagattcctaaatcaacactccggggtgggacttgagaatcaacactttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggatggtctcaatctcctgacctcatgatccacccgcctcggcctcccaaagtgccgggattacaggcgtgagccaccgcgcccggccgagaatcaacactttaaccagcttcccaggcggttgtcgtgcccactgaagtttgagaaccacttctccagtcagtaatgttgaggaattggggatagaaaaatttatcaggaaacatgtacaacaagcaccagatgagaagtgttaaattaaactaaacctgtaatcctagcatttggaaggctgaggcaggaggaggccaggagttcaagaccagcctgagtaacatagcaagatcccatctctacaaaaattagccggccacagtagtgcatgcctgtagtttcagatacttgggatgctgaagcaggaggatctcttgagcccaggagttcaaggctacagtgagtgaggatcaccaatgcactacaacctgggtgacagaataggaccctgtctcaacaacaaaaaaaaaacagaaaagaaaaaaagttaaactaaatctggcctgaggctgtctccctacttgggtctttgcataagacactgcaacctaacttagtatgcaaactaactgaaaaccaaatataagggtatacttttttgtaacaaatagctgagtctcagccaatcacagctgcctagtcagtcaatcacaggcagccaactgagcagaccgtggtcaaatagggcaaatgctgagccttaaccaatcaagttctctctgtccttcacttccattttatgtccataaaagttctctgaccacaatgcagcctggagctctctgaacctattctggtcttggggttgcctaattcatgaatcattctttgctcaattaaacactgttaaatcttatctgtctataggttttcttttaacagatgccacaagatttaggttttaatcgtggagaataccagcagatttctggaagtaaaagagcaagaaggcacagagttcatgctcagaaaatatatgttgacttaagtcagaggttggcaagctttttctatacagagccagatggtaaatattttaaccttcgtggtctgtatggtttctgtcacaactactcaactctgccaatgtagcatgaaggcagatttaaacaatacgtaaatgaatgggcatcctgagttccaataaaaccttttttctaaaaacaggtgtcaggatagatttggccaataggccatagtttactaacccctgctttaggttatttcaaaagaagagataaatcagataagattagtattaatacttggcccaaaaggcctatcattcagcttgtaaggaagtaaaagtccacaaaatctcctactctccaaaaacagcaatggaagctccatctctcccttgacagaagaaccacccaaactggctagtgctccttttagtgccaagaacaatgatgggttttgtcatgctgatactggcagccaaccacctttctctcactacctaccacctattatcacacaaccaccgctaaagcccttagctatgtgggcctgtggcttaagtgaggttccggctgtgatccagggaaaggccttttgtggctttgtgaatgggggtcagaaatctaggaaatgaagattttccagttgtctaccactacacatgggcatcactaaaccgatgaacttcgagttccttatctgtaacatggggactataattcctacccttcttcctcttagatttgctaacatcaaggagattctggatgggtcaagtgcttggggacctgcatagtcctctacctatgggagcaccctgcttgtgtgaatattatcatcagctacctggcttcattcccttgaccccatctagcttcctatttttttcttccttattgatccacaataaggaattgcacaggaaatcatgagcaggttgaagggaaatgttaggtctgaagttaaatttgagagagaaaattgcccccagttgtgtagcatgttcttcactgaatttatggcagagaactatggcctagaagaggggctgaccacaactgaatgcccagaggtaaactttaatgtggagggattttttgaactgcttccttgtctttgagtaagtggatgagaggggggtacttgaaactggacttcaatgttgaatttcctcttgcaaaaattcaggaggagagccagtgcctgaagggcatttcagggagaagattcagccaccagagacctactatatgcccaacacacgtagttcctaaggatgaaagggaacacaaagatgacagcccctctcctcctagagtttgctggctccagctcggaggaggtgtgagtaacagatatacgcctcatctctctctcgtagcacttttcttctagcactttatcaggtcttcgtgtattctttttttttttttttttttttttttttttttttttttttgtgagacagagccttgctgtgttgcctaggctggagtgcagtggcgtgatctcagctcactgcaaccctacctcccaggttcaagcgattctcctgcctcagcctcccagttagctgggattacaggtgtgagccaccatgcccagccagtttttgtatttttagtggagatggggtttctccatgttgaccagactgggcttgaacacctgacctcaggtgatccacccacctcagcctcccaaagttctgggatcctcctgtattcttaacatatcctttgtaaaattttaattttgttacaaaatagcacattaatattaatttttaaatatgcctttaaaatcaaaaacattggaattaaaatacaaaattcccacatctgcttcacccctaagtgtccacttatattctcacactgcaggaggaactactgtgaatccttccagatctttctcaagcatatacaaccatgtgtatacaagatgtgtatgcatgtgtattttctatgtttgggttcttgcagttggagatgtatgcggttttatacttttctcaaaaataaattgattccatttgttttttgaaaaatgggttcatgttgtacttagtgtgatgaacatttcatatttcacagtaatatatcctaaatctccctccacgtcagtatatacagatatgcttgagtctttttaacagccatggcaatattccactcaatagaattaggataatttatgaacaattatcctcctgtggtacatgcaggttgtctccattttttgctattacagataatgctgcagtaaacaccctggggtatacgtgtgtgagcatttctagaagagattattagaaattaaattgcagagttaaaaggaatgcactttttcaaatttttatagatattaccaaattcacttccagtagtatgtcgtattgtggcactgtaaccgaatagcctggcatcaaccctccatttaaaggtatttttttttctttcccctttcccctgcagtttcaagcagcctcagaatgctttctttcctgcattctttttcttttcccattctatgctcccgcgccttgtgccattccaaaccctctcttgaaaaactcctgtgttccctccacaaattgaagagtaaaaaattttggaaagaattccacccactctgccccttgcttgcatggataataaaatctcactctctttttattacacctcactcatgtttctttctataagcagcgagcagccagactttgtgctggttacagttcattgttgtcattttaatgtgtttttcctcggtcagtagggaggacttaccatggtctcccttgcattatagctcttaatgttcaagttgtatttccccgctatggtgaacatctgctctgctgcccagcatctagcctccttttttctggtaattattctctgattttcctttggaaaaccacttctgccaccccccatatatatagttctggtgaggctgactctgcctccaatccaggggctgaccactagggtcacaatgattggttcaggtatgtgcatgtgcaggggtcccaatctagacaacaggagttagtgccaagactattcctggagctagcaggcaaaatggagagtgggcatgaaactgtctgtcttttctgtccccctaccaaagcagaatctaatccaaatgacccctaaccccgctgagggacagggccccagggacagggcagggtcaaattgtgtgcttcagtttccccatctataaaatgaggaggttggactctgtgcctctaaaaccattttagctcattgtgcatgcatgaaacacagagagtacaaagacttggctgaagtgcagatattatcttggtagaagaaaatctcctcaagggtggctgttctgcactgatctgataaaatgacaaagtcaatatttatccaaatgaattaaaaacgcatgccaatccaaaatatccacaaagatatttatagtagcttaatttgtttgtttctttgtttatttgagacagaatcttgttctgttgcccaggctggagtgcagtggtgcgatcttggctcactgcaccctccacctcccaggttcacgtgattctcctgcctcagcctccagagtaactgggattacaggtgtgcaccaccacgcctggctaatttttgtatattgagtagagacggggtttcaccatgttggccaggctggtcttgaactcctgacctcaagtgatccaccctcctcagccttccaaagtgctgggattataggcctgagccactgcacccggcagatagtagctttatttataattgcaaaaacttgggagcaaccaagatgtctttcagtaggtgaatggataaataaactgtggtaaattcaaagaatggaatattattcagcattaaaaggaaatgagctaccaagacataaaaaaacatggagaaaacttaaatgcatattactaagtgaaagaagacaatctgtaaggctacggtctgtatgtttctagctgtatgacattctggaaaaggcaaaactatggagacagtgaaaatatcagtagttgccaggagttagaaaagagggagagatgaacaggtagagcacagatgatttttaggttagggcagtgaaatgactccatgatactcatggtagatacacgccattagacacctgtccaaacccacagaatgcaccccaccaagaatgaaccccaaagtaaattctgggtgataatggtgtgtcagtgtaggttcactgatgtaacaaatgtctcactccgttgctggatatcaatagtaggggatgctgtgaatgcgtggggctgggggtatatgggaactctctgctcctttggctcaattttgctgtgaacctaagactgctctaaaagaatagtctatcacttatttttaaagacaacattaggttttggtagacaatctctaaactgggaaccatattttagatgctatgcctggttctgtcctaaacatagtatctttgtgtgtgctcacttctcctctctgggcctcagtttcacaatttgtagaatgaagggactgttatgcctctaactaagtactatgagtctatgatatctatattatatatatacacacatatgcacacacacatacatatatatgttttcattcatggttttcaacacatatgttttcatccatggttcctggctcataattcccatagcccttgtaaaagcaaagagaatctctttttctctagctttctcctcccctcctttcacctgcccaaggcaggactctaatttgattgtgggtcataagacccttattccagagggggtctagccccataccctgaagtaaggaatgctgcatagagaggccaagaagaatctggacagcccttgctgggtttaaatcataccctttgaagatgtgattgagttagggatcttgagatgggaggtttatcctggattatccttatgtttaatctcaagtatctttataggaggaaaacaaagggagatttgactacagacaagagataagaagcccatgggatagaagcagagtcagagagagaagacactatgggaatatcagggaaggagccacgagccaagggatgtacagaatgctctagaagctaggaagaagaacaacaacaacaaaggaaacagattttccttcatagcctctggaggaagcatagccctgctggcatgtttactttggctcattgaaactgatttagggctctggccttcagaactgtaagaacaaatttgtgtgttgttttatggcactaagtttgtggcaatttgttagagcagccataggaaaccaacacaggcaaaagaaaggacctctgaggcttactccacatctgtcaaatgggatcaataccacattcattcattgaatattttttgagagcctaccatgagccaggcctaagaactgggaaggtgaccaagtacttcccactttcatggagcttaaattctagtgggaggagataaacaacaatggggatacacacacataatcaagataattacaaattgtgagaagcaacatgaaaaaaagcaggggtatgactgagaataactagtcaagcagagggtcctcctttagatagagttgtcaagggaggttgttggagcagaaaaatcttgacctaagactagcataacaaaaagcagaggataaaaagtgcaggcacagagagcagcaaatgcagtatccaaggagggaaaggacaaaatttaatgcaggaaaaaaggtccatgtgactggagcatagtgttctagggagagacatgaacaaggtgagttgggagagaggcagcagctggatcatgcaggaccttgtgggttgtggtgaggaatactgatatgttctcaggtcaatttggagcaggaggaggtttcaggaaggggagttgcatcatcatttgctcttgtgaggaaatagattttaaacagggaagtggagaggccaggaaactagttaggaagctagttttccaagtgagggatgatgctggcttggatgagaatggaggtggtgaggatgaaggattgctctgaatactgtataacataaaatgcttaataaatggtagctctcgttacagtatgatgatgatgatgataactgtcattatcattattagcttttgctgaaaaaagaaacggataaatgaaactcagttgggtcataagagttgacacctgcaacaagtgagagaccccattcccgttcaccagaagaagccacttgctgatgccactgaccgctcctcatccccaattcactctccccagcaagttcagaaacctaaaaatgtgtcagagcctatacctacacacatgaatatgtgattaggccacttaggggttctcaggaatagcttttttttttttttgagacggagtttcactctttttgcccaggctggagcgcagtggtgcgatctcgtctcactgcaacagagcttgggaatcaaaagacctgggctgggttaaagtccctatctcaccactgtatccctgttcactcactgtgttccttctcctatctgggcctcagtttcccaatcggtgagacagtatgagtcaacgaaatgaccttgtaagttccctccaacaataaaatgatatcataaaaatggttctcctctctgggcactgactgtgactcaggcactgtacttgtttattttctcatgtaatcctcacgcctgcctaaagacacactcattagtattttacagttgagaaacaccaaagcacagagtggtggccatcagaaagggagcagtattgttagcattaaaaacattgtcctttaatcccagcactttgggaggccaaggcgggctcaggaattcaagaccagcctgggcaacatggcaaaaccccatcactacaaaaaatacaaaaattaggcatggtgtcatgcacctgtagtcctggctacttgggaggctgaggtgggaggatcacttgagcttgggaggtggaggttgcagtgagccgcgatcacaccattgcactccagcctgggcaatggagtgagactctgtttcaaaaaagccacaaaaaaccccattatcctttatcctgatattatgttcttccagctttagggggttgaaatattctctttttttttaatggtgatattttaaaggtttttaatggagagaaatgagaatttgcccatctatatcagtccctaacatttatttagaaatttgattgatgcatgaagtcccagtcttgaatggcataaagtatgcacaggaaagggttttcaactatttcagagttcctactacgccctagtcatagcagaggaacacagagataactcaactgcagcttcagaggcacatgccaagaggcctggaatccaatcaaagctctgcctctagtactaactgggtcaccttaggcaagggaggtaacccctctgagcctcagtttcctcatctgtaaaatgggggtaatcatagtgcctacctcatgtaacacacctcatctagagcttggcacatagaatagactcaatacatgtgagtcgctattatcattattatttagatgggggtagaaggagtcacattcatcagccacagactatgaggaggtacccggggccgggggagggtggtggtggtggtggtggtggtgaggatagggtgatgaattttcatccaggtaggggtttcattttgtctctgaagtctctgacttctagcccaaaggagtaccagtgatcatttctaccagattatacgacctcaggcaaatatttcccagctctctgccttggttctctaatctattaaaaaagaagcaattatttccactccatagaacagtggactcaaacttcagctagtatcagaatcacctgatgaacttggcaaaataacatggcacagattctatcctacttcaacaagtctgagtctctgttctttattatctcttcagatgctttgatacacaccacgttttaaaagtgccataagccatgaaaggaacaaggctctgtgtttactctaaaggatcataggagattattatcattatttacatcccatttgctccactctttttggagatgtctagtgggcaggctgtcttttcaccagttgcctgccccacccaagaaaagctggcctgcatctcagcgttaccaaacaccccatccaagcccttggggttctcatgcctttggaagtcatctacaatctagtatccatcttgcaaaggggacactggagtttgaaggggaataatatctttccaagggttgccacagcttcatagttagagccatagcggaacccagggcttcggatgcctgggccactcgtgttggaagggcttattttggacatccccaccctaggagaagacctcctgcctgctaacatgtggtgcaatgagttggggtgtggagccccaccctacaagcttttttttcactgacgatgcctgggaagagctctggccaaacactgatattccagccacccctttccaaaaggcctgaagataattcagagttcttctcaaaacctggagaggaaggcaagaactagctcatatctaaacatagcaagctcctcaacaatcttattactgaccttgctcgagcaggaacacagagctccacctgcgacatcaaatctgagattacaaatttaaattgtggaatctcaggctgtaaacgagcaggtcacaggatgcagcctgctacttcacagaccagtaatactgccatgtaatggtgccagacaagggaataacacttctcaaatcacagcaagtgtttcagttgattcaggacaagaagctggcagggtggggccagcattaaaacaaaggagacagtgctgtggtcaaagctgcaggcttcagaaaaaacaaacaaacaaaacaaaaaacaaacaacaacaaccaaaaaaaacctggctagcggggagttcggatttaccgagttccagctgtgacctccagcaagttattcttttcctctctgagcctcaatttccacatctgtaaaaacaaactaacaaagctaacccacagaagtagccaggctttgtggagcttgaagcttatcccatggagaaggggaaagtagtggtaaggaggacctctttaagaaaaaagcaatacaaaattgtccattcaaaattgcatacaggaccttggaaagagccccatgtaagggaggggcctgacaaatctgtcttggatgctaccagttagcagtgacattagctaagcaaagcttgtggcatgtaataagcccttaagaaatgttagttttggggatgagatgatggaggagagagtggtatggcttgagtcaaaagctgtaattttgagggaggaggaaattttggcctgttcatctgcactgaagcagagataatgacagagagtgggatactagagaaacgcccaagaccgtctttagctgcagagttctatcctggatttcatgtgtgaccttagacaaatctcaccacctcctggcgccagtatcttgcccagcaaactgtggctgggagtcatacaatctcagcctcttccccgtttccagaagaacactctttactcactccatggagcctcacaaaagctaagaattaattagagatgactgagtgactgtcccttttttgttccaatttaagaatggggtgctgcaagaagggatgtcttacagcagactgtggagccagtgagacatggaaacctctaccctgagatgaataaaaggagagggatttgtaggtattttcttggagacagaaataggttactggttgaaaaccttgacaaattgggctaggttccaactctgtcactttctagctatctgacctcgggcagattcctttacttcaagaaacctcagttttctccttacttaattgatagggttaaatgagaaaatgtagataaaacacttagaggattgcttatcccttagtacagggcttaatagatatttgttattaaaattatcagtataatagttatcattatgattattattaagtaataccaatacgaatgggtgatgccttttccaaatccctccttcctctcctcctcttcccaggagtcctcgtccactggcttctccaggcaggaagaggtgccctccagggaggtgggcggggcctcgttccagcttggccagagccagcccgggcacacaccactgtgctggggtgtacatctacactagacaccttcctgcttccctccttccagagcagacctctttgtcaccccgagctccttgtttcttaagcagtcatgtctgtgacaaaaagtactgagggtccccagggagccgttgccatcaaattggaccttatgtcgcctcctgaaagtgccaagaagttggagaacaaggactctacattcttggatgaaagtccttcagagtcagcaggcttgaagaagaccaagggcataacgtgagtgctgttttctgccatccctatttctgctttctagcctgaagcttgcattggcaaaaaccctgaggtgggtgtgtctgaccctcaacccactgtgcagatgagaaaccaaggttgcaaaaggtgcagtcatgggctgagtcaagctgaggcagaagtaaaggctgtcagaaaagcccttagggacatagtgatccagatcccaaaaggcacaggtggggaaactgaggctcaattaccctggaccacatactgagtcattggcaggataagggctagaattcagtgctggccctaaagccacatttttgttcctggccagcgatgttaagattggggatagaggtagaatccctaactacttggaggagaaggtgagtcctgagcttaaaaccacagtggcctcactgaccactaagtatttcctcctccctgcctccttcctgcagtaagcctggcctctacttcaactgagaagcatagatgactctaaaaaacacactttgtggaaagttctagttttttccactttccagggagtggggagtgggggttattcacaaggcttccaaaacataaaaaaagagggaagccaagctacagggctgcagctcccttccccacatctgaccccaccacccaaccagacttgctagtttacttaggaacaaaaggtgtggggtgtggtagtgaagaggttctgctgctttaagaagaaagtttttgcaccactagatagtagaaagagcactggacagagaatcagaaggcctgagttcaagtggtttctctgctccttctctaagttccagttttctgacatgcaaaacaggtggcagtgtgaactaaaggagggtgcatggaaacaaaatcggaggatgtgtttctcgggggtgcactgcagggagggactgtaaggggcaggcaaagcccctccccacagccatccagcaggacaatttagggatggacacagtgactggccctgctgcctgtgctgtcgccccagggctagtcctggaagttgctaagtattagtgaccctgagagtgtgctgtctgtaagttggggccagccactgctaagtagaggcattttctcagtcagaggccttgagggaaccacctgtctcttgtgtcctgaactgatacaaggtttgatggcaatttcagcaacttaaggatcaaaggaataaagcaagtgagagctaaagggagacacgtggcttggggagaagccaaataacgggctgagtaagcgtggcaacgatggggttggctcacccagactcgaattcccacttagctgcttaccagctagagcaaatgctggaacttctttgtgtccagtttctcctctgtcaatgatagttctctcctcctgggagatttgagcataaataccccagacacagtgtctgtaagtgttggctgctgtgaataagatgacagtccaaggtgaccaaaaagaaaggagttagagttggagcccatgtctcccaactcccagtttggtgctttgcatgacttaccgcactatgttttcaagttggttgagtggcccaaagttaaattctgatttcctaagtactttagttagaaatttccaaagtaacccgctgaccctttcctagttgcaaaacaagcccattgctagcctggcgagtagggtgtagtgctcggtcagcgatgtggacacccacagggagaaaggcatgcagggactctccaccccctttctccctcgattgttctctttaacccttgatgaatctatgtacagagactcaggaagctagagggtttacagcttcaatatgaagcttcctgagcctctgcccatagattcttttaaaatagcatcttttaaaaatagcatcactcctgacatttacagagggtcaacaaagttgaacacgttgcccaagatgacacagctagttaagtcgtggccttgaggtttaatccctggtttgtcaaatcccagagaccgggctcctttcagagtacctctgttgttttacaaagaataagtctcctaaccagaaggttctcatggggaatttccaaggtttctaaagttgcacgtgtaaaccccatgctcgccttgacttaacctggtacaggtacaaaaacgtgtagaaataggttgttttgtaattccgctaatagagtgcctccctggaacattttttctcctgatggtttagactttgtcctccgggcaaaccttcgcatttgtcttaaaggaagggtctgagtttttgtttgggggaggggaggtgtgcactctccagccttgatgccctgggctgagaaaagaaatccctctggagcccaatccctgaatggttatgccccgccagacctcatctggggacccagtcatccgacctgtttattcagaagtcacaatgattttttgtttctgcctgccctttccccttttctctgtgttcaagcctgtctctactactagttttatgacattgagctagtttctgcccctctctgagccttcatttcctcagttatgatatggggttgtttctttacttacgctgtctgagtttatctctgggaggcagctcagcagaagtaggggtgaagaacagggactctgaagcagcactgtgttaaatcttggctccccaatatatcctggataagtcattaacaaatctctgtgcctcagtttcttcacctgcaagatgataatcgtatctttgtcagagccttgactagaagattaaatgagataatactgatttaaagcacctagcacagtgtctcatatagtaagtgttgcagcatatattgagtgttagctgctaaaaccaggacagttctgggcaaactgggatggttggtaaccctacaggagacccagatgtgccaggcaaggactcatggactgagagatggctaggagcccgcctatcaggtgctggcatgctgcaagggaatcaccgctggatcttctcacctccacacacccatacttcacatctccttcctctcctttagagtgttccaggccttgattcacctggtgaaaggcaacatgggcacagggatcctgggactacccctcgctgtgaagaacgcgggcatcctggtaagagaggcgccacatgtgggggctttatggtcagttgcagaagggaagtaagaggagaggctctagcggtttagcaacctgtggtgagcagtctttctgggacacagcttggtgcggggttagggtctagacatctagcctgggtttgagttccggctctgccacagactttagtacctttggtaagtcatttgcctgctctatgggccttagtttcctcccctgtagaatgcaaggattggactatgcccagttttccaagtatgctctatagaacaccaggtccccttggggatgtttcaggggccacaaagggcacacatggtcaggattctctgtccccctactcccatcagtataccccattgtaattgctttatgtgctttattggaatattacttgaggtcatatttgaaagaatagctgttgctgctacaaaagggctttaaacccagtttgctagagagttctttgagttctgcatgatatcagcactaccaagcccatcttgcagtattcttcataaatgcattctcttctctcctccctcgccccttgcctccccttcctccagatgggcccactcagtctgctggtgatgggcttcattgcctgccactgtatgcacatcctggtcaagtgtgcccagcgcttctgtaagaggtgaggaaaacagcctccttgtgtcaattcctttggtgcatggttctcagggatagcccagaaacatcctatgcataatagaaatttacttcttagttttctccaataaggccaagaaagagtgaagagcattcaggggcagggagctcaggtgaggctcttctgcatggctccttaggagatctcagtcaggctattgtgcttatctggttggctcctctggaaattgggcataaactatgcagagaatggtcacgagaatccaatgggatcatggatatgaaaactaccgtccccgtgcaaggtgtgcattagactcttgctgtgtagtctccgcctcatttaacaggtaaggaaaacaagccactgaggaattactgctgagtgtcaaagcccgaggtctctgcccctgtgttctttctgctctttagctgtgtcctgccttgttctgtgtctcctgacttttgaccatgtgagtttaggctaaactatctcttggaaaccgtttatgcactctctcctgcaggcttaacaagccctttatggactatggggacacggtgatgcatggactagaagccaaccccaacgcctggctccagaatcacgctcactggggaaggtaacctgttcttgctttgcctgcagtggggtaggacacaggaggagaaaatgctgctatcagggtgacttcttccctggaaaggtggtttgtttggcacttctatgttagatgttgtacatggaaggggttcattggcaacatccctgatcaacccccacttcttgtgtatctctagtgacaggatactcattcctttgctacgcagctttaatgttttttactcttttattaaaccacatttatccagttactcctatggccctggacatgtcatggggactgagaagaacaagactttgccctcacagaacccatagtccagtgagaaaggcagacattaaacagcctagaatagagttatttaatagccgcttggatatgtacgatgaaggaaagaagggctggttgccaccaggcaggttaggagatgtgtgttggcttgggggagaggagggctttctaggatggaacgggtgagatgagttctgcaggaaggagtcctgaagaatgaggaatcacctcaaagaaggtggacaggggcctggagggtggggctggaaggaagagagggtgtgaaggtccctgaagcaagaaggtataggtgacagattcaaggtacaacaagaccaggtagcttgagggcagagagtcagggaggtggaactgaagaaggagccaggcacccaatcaagtggtacattttagaccctctgaaacgaagactctatttgttcttttcttaaaaccaaccaggaagccattggagggttttaatcaggaaagtcatcatatttgtattgtttaaagatctgtctggcttctctaaggagaatagattgtaagggagcaagagcagatttagtcagatccatgagggggctattaacagtacccagccaggtcacaatggtagctgggaccaagctggtggcagtgggatgaagaaaagttgacttgatcatgaactggatcctgggattgggagacaaggaagagtcgagattgactcagatttatgatcacttctattttggacaagttgagtttggggtgcctgagaaacatttaagtggagatgtctagtggggatatatgggtttaagcctatcttcatgcaccaatccagaactgaagtcatcagccatgaagccagggacagagaggtctcttagggagaggttatatggtgagaagaaaagagaggaaaagaccaagactttaagaaccctttgttgagctgagtgaagtcttgctccctgaaaaatcccaccttttagctctcaggggtgacagagaacaggttaacaccctttgtcctctggtacttgggactaaatctactcctttctccttgtttcagacctgtccccacctgtctgtctcctcttgttgagcaccatctagactgtcaaattctcttttgaactgtgcttccctaaactgctgcagtactcacggtgtgcccctgcccatggcaggtagtctgtatggtatcatgggcctggaaccacccttcgctcaaagcccatactcacaagagtaatccacaaattcagtctgtgaacagacaaggaagactactggataatgaccagaattttcccaattgtgtgacccaggaggagacttgcctgtcacagactgtcaaatccttctacttgttgttgggcatataaagaagatttccctgctccatttagggatcttctttcattaattactgcctctcctataactggaattcctttagtatgggttcttcctctcagcatttaatgtgttcctgtatctccagcaaaccaccatggcacatgtatacctaggtaacaaaagtgcacattctgcatatgtaccccagaacttaagatacaataataataataataaagcaagtaaataaaacttcctggaccttaccattgtagccaacatcctatctacattcaatatatattattcaacaaatgtctactgaatacctacaatgtgtcataaagtgctttagacaatgggtctactgcaacgagcaaatgggtgccatcaacactggaccaccctctgattttattgccttacatcccatccacacctctttcacaggccacctgggttttctgtccttataattctactgaagttctttcaagcaatgtcctaaaagaccttcttgttgtatcttccttgccctagagaacctttcagcagtaatgtgtataattgaccattctcttttttcaacattctctcctcacttggctactattaaacctctttccccctagtttccctcctacctttctagccactcctttgcatttgttgtaagcttttttgtttctattaaatgttgatgttctccagggttgaacactgtcttctactctcctcattctgcacactttctaacactgctctgcctttgcaaggctttatccactactacaactcaacagttccagaccctaatatccagttgtgtcccgaacgtctcctataggaacctcaagttcaaagattcagattctgaatgtgtcatttcttccccttctcctaaaactgtcctcctcctcctcctcgtcttcttcttcctcctcttcctcttctcttagttcttcttccacctcctcctcttcttccccctcctcctcctccccttcctcctcctctccctcctcctcctctcctcctcctccacctcttcctcctcctcctccttcctcttcttcctcctccttctcctcctcttcttcctcctccttctcctcctcttcttcctcctccttctcctctttttcctctcctcctttttcttctttttctctctctctttgtccctccctcttcctccccacaactctctttcttccctttcccaaggggctgtctcttaggtattgggttttctaacaaggctttctgtctgcccataatttagataaaatgcccttttcaccatggcccttaatgctatatctaagaatttttgtccacctaacccattagtctataaaccacaagaggaagggactgtatgttatttgtctgtgtattctcagtgcccaacatagttctggcacatggcagaaaaaaattcaaatgtgaatggtagctaataaaaacattgtgcctgctgtcccacattaattggtatcaatgatgaggaatgccaccaagcccggtatcgggagaggctcataaccaggaagaattttaccacttgctgagctgagagtgtgagggtggttaaaaatcatcttttaaaaagaactattgttggccgggcatggtggcttatgcctgtaatcccagcactttgggaggccaaggcaggcggatcacctgaggtcgggagatcgagatcagcctgaccaacatggagaaaccttgtctctaccaaaaatacaaaattagccaggcgtggtggcacatgcctgtaatcccagctactagggaggctgaggccaatcatttgaacctgggaggcagaggttgtggtgagccgagatcccaccattgcactccagcctgggcaacaagagcaaaactccttctaaaaaaaaaaaaaaagaacgattgttaccttacttctttgccccattgttgattgtggtggaaggaccaagtgtgctggtacagggcaaccaatccctgggaacagagggcagaatggcaagaaatggaactgacaagttgacttattttataacaagttttctttttccctctcttctcccttctaggcatatcgtgagcttcttccttattatcacccaacttggcttctgctgtgtgtacattgtgtttttggctgataatttaaaacaggtagaggcttctagagaaaacgggaggggaaaagatggacaaggacacgccactgctagttgtttgacaaactgcttcttctctctggtcctcatcaatgtaacaaaggaagttaaactagatgttgtcaaacttgcctcccctagttcacatatctgaagatctctgtgtggttacttttgccacaataccctttatccggtatcttagacctgttctcaaagttgatctctactgaactggaatggaaagacccttggattttgttaatcctcctgccttgaagcttaattatacttaacgcttctaaaattgatatgggtcttcttttgatgattcctagtcttctttaggtcatctttctttctttttttttttctttttgagacaggatattgctctgtcacccaggctggagcgcagtggtgagatcacagctcactgcagcctcaaactcccaggctcaagtgattctcccacctcagcctcccaagtagatgggaccacaagtgtgtgctaccatgtctggctaatttttttttattatttgtagagccgaggccttgcagtgttgtccaggctggcctcaaactccagggctcaagtgagcctcccactgtctcccaaagtactgggattatagcatgagccaccacatccagccttgggccatctacttaatctatggcttaatagttattgtccctaggaattctttctgatctaacctagaaattctcttacagcaatttgagcaaaataatatgggtaatagcagaggccatccttaatcagtaagtttaaaaagaaaactattctttagggctctttttctgcttatagcagtaataccagaaattcaaaaatgtaaactagctagaagaaaaatgtagtaagctttcagagttagcttctattatgtcaggtacagtgctgagcattttacatgctttccatcattgaattatctccatgaccttattagagcaggtactgtggttattcccattttgcagacgagaaaactgagattataaactctgtaatgtatgtaaggtcacagagccagagttaaaaacccaggccttctgacaccagtgctcaagttcttaaacctatgctgtatttctgcaaagaaaacaaaataaaataaaataattcttaatccaactattcatggttataatttaatgtaaccttaactggtcagtattttgcaatatccttatatttagtcatgtaatttttaatagtttcataatattccatcacacagattgatcataacctaatcaatcttctattgctggacatttcccttatttccctttgtttctctactatcatctgttggcacaaaagtctttgtgcacttctttatttccttaatgtttcttaaggtaaaattactgagtcaaagagtttgattgttttgaaggctcttaaaacattgccagattgctctttagaaagcaatctgacatgtacagacctatacttatcatctgcatttattgttacctgcatttatttatcatctgcatttattatcaaggcaaacactgtatcaaggagtttacagccaagtagagtgtgttctaaaacctaataagttaaatatcaatatgatattttggtgtcaggccaggatgccactaacaacaacaacgtgaggtcagggtgcaaactacattgcagagatcactggagcagggaaagcctcctccggggggtggtgcatctgagctgggtattgacaggttagagaaaaaaagtggtggcagccaaggtgggagaaggaatcagtgaaaaccgggaggcaggaacatatgggattgcccaggagaagcaatacaattggttcaaggaggaagagtaggtcatgggagaggaagaaaccttgaaggtttgatagggcccatttatggagggccttgagtacgtaactaatgttccagctatttttccaattgtagtgaggaatcagaaaaaaatcaatacttaaatgattcatttatgtatccacagtgtattgttaagtgcaagggacatttcaaaagaaaagagtgaatgctatgattgaagtcttgtaaaataaaaagaatgtgtataatatatgtaatttgtgatattgtatagaaaatatatagatgagtatcctccaagatgttagcatcttgatactgagattatcaatgcatttgtgttttcctcctgctgaactctagttcctaatcgttctgcagtgatttgtattgcttgtccagtaagactgtatcagttaggtcatgctgactttaaatggagggtggtagcatccacctacccctgactttacaagggggtgttcataatgtgtgggggggtgggggacggtttcttgtttatcacaatgattgggcatgctcatggctttcagtgggtggggtccagggctactaaatgttctgcaatgaatggtccaatccacacaagaaagagttttcttacttaaaatgccagtattgtgtcaattaggaatcagtaagcgtatatgttaattaggaaacagtaagtgatagactttttttattatacgcaaaaaaaaaaaaaaaaaaaaagattgagggaatttaagcagaaaataagttccatggaaggatattaccttccactaaattaaaaagcagatctgagggaagaacaggagccagggtagcgaggaggatatagatggaagaactagtgagcagcctccactatcggaattaatctttacccttttctagtccgtccttaggtccctatgctttaggtttacattcagattcctggaagagggtctgaatgccccagcttgagtcaaaggctaatcccctagctatgccacatgactgtgatttacagtcctcaaaggctgcattcaatgacaagaaagaactcaccaaaatcaaattggtatcaggagaaatggatactagttgctaaaagctaacaaatagccactgcgaatccagttatttattttgtgttacacttattttttaactatttttacaacttttttttttttttgtggatacagggccttactctgttgcccaggctggagtgtggtggcatgatcttggctcaagcgattcttgtgcctcagcctcctgagtagctggaattacaggcatgcaccaccacacctggctaatttttgtattttagtagagatggggtttcacgatgttggccaggctggtctcgaacttctgacctcaaatgatccacctgcctcggcctcccaaagtgctgggattacaggcgtgagccactgcaaccagcatgtacagcctcttctgaggtagtatggtgtagagggtttagaataagttctacattcaccctaactcaccgtgagatttggcactgtgggacactcccattcactgtgagggaatttgattaggggcaaggcactgagtcaaccatgaggttagaagactcatcatctcccccttttgcctctcccattccttcctcaggtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggtgagtgcacaccatgcacctgcccactccactgggcagggtttttttatcaaggatagactgagctttagatacctggagccaaccctgtaggtgggtaagagtgttatgagagacatgcatctcactgtagcatttcttctacaaggatgtctccgtgcagtcccattcttctgattgtctccttgttcatgttctttctccaaatatctatttttatgtcaaattctggcttttttaaaaaaatgtgcttgcaaggaaaacatcttggttggtgaactgtagaccattcctataatggttggctggcagcaaaaggcaggcgaaaacagattcttgtactacagctaaaagttattgcgttacccatagggtacaatttcaggtacccaataggaaggcaagaaaaaaaaaatctaatatttagtcacagagatatacatagagagtctcaaaaaccataagctttcaataagtgtcttgttactaatttaaaaaaaaactataagcaaatctattataatgttagttataatgtctttgatgttgaattatggacattgattttctgtcagtttcctaatttgctatcctttctaatttttcttttatttatttacttacttattaatttatttgagacagactctcgatctttcacccaggctggagtgcagcggtacaatctcagctcactgcagcctctgcctcccgggttcaagcgattctcctgcctcagcctcacgagtagctgggactacaggcaccagccaccacacccggctaatttttgtatttttagtagagacggagtttcacgatgttggccaggctggtctcgaactcctgacctcaagtgatccccccgccttggcccccccaaagtgctgagattacaggcatgagccaccacgcccagcctaattcttcttttataatagacaacactacatagaaagttaagtctcagaagccccttggcatatttaataaattccagatgttcttccctttaagaagccacaagagaaaaaaagttacattgtccgtgaaatttagtaaaaataatagtcaaacattttagaataactgcagatcagcctcacataccttagaagacactgatgaattctataaaattgaatttcctaaagaaatagctacctttaatacatttttggacaattccaaaggttgcccagttagaaaaatggctctgtcatcattttcacattctgggtcacaaggtatatagaatatttattctacacagtcttctccccttcaatttacagctcattaaagaaaaaaatggatctttcatatttaactcatactttgggctccttagattattactatgactgcagtcacaggaatttccaacacccatgaccactgtccattcaaaggtgttcgtgggctcgttgggtcagtgctaatctgtggtgtgtaaggtcttcttttggaggattgttttgttttgtttttgagatggagtttcgctctttcacccaggctggagtgcagtggtgcgatcttgggttcacaccattctcctgcctcagcctccagagtagctgggactacaggcgcccaccaccacgcccggctaatttttgtatttttagtagagacagggtttcaccatgttggccaggctggtctcgaactcctgacctcgtgatctgcctgccttggcctcccaaagtgctgggattacaggttaagccactgcacccggcccttttggaggtttttcataaaccaaactccctccatgaaatactattccttcagtactttgacaataccgtcctctggctctttggcattgtgcagtgttgaaatcaactttgatcgtggcctacatccctttgaagttttctaaacttcttgatattcaattttaaaaaattcaggtctcatttcagagtacccttctcttaaaggagctcaaatgtgctttaagagtgactgtctcatagcatttctttcttctttaggaaatcccagaccccagccggttgccactggtagcaagctggaagacctaccctctcttcttcggaacagccattttttcttttgaaagcattggtgtggtaaggtttgaattgaggtggccttatccctagtgcttgtgagtgaccttctagaaaggaactgtgagctctgggtttctgtgtcccgctggccattgttttgggcctgctagaaaatgcccatgggagaaagtaacctctggccttacttgggacagttgtcaccagcaagagaaaagttgattacaacagagaggcagtcaggagacagttttatttttgtccccacatgcctattaaacatctatcctcctatcgacatgagtttcctaatcttttaaaatcaagaagaaccatggtgtccaatttaaaggatttgattaaacataaaggagttttaacctggaaagttctgtatttacagtctgtagtctctacttccacacttgtggaagggtagtgttgtttatatatttttaaaagttacttttagtgtacatacagtaacattcacttttttggtgtacattcctgtaagtttcaagaagcatgtagaggaataaatgcaccaaagtcagaatgcagaacaattctccttctgttctctgcctgtactgtcttctcttttccaaaatgtcacatatatgggatcatacagtatgtatgagattgagactggcttcttttacttagcctaatgcattttaaattcgtccatgctgttgcacacatcaataacaccttgctttctattgcagagcgtccactgtctgggcagtaccacagcttatcaacgcacctgtcaaagaacatttgggttgtttctagtttttgacaatcatgaatgatactgccgtaagcatttgtgtacaggtttttgacattgaacatcttttcatttgcttgttggcaatttgcacatcttctttggagaaacatcaagtcctttgcttatttttaattaggctgtttgtctttttgttgagttttaagagttctttatatattccagatacaaaatccttatcagaaaaatggtttgcaaatattttttcttattcttgtcttctcctcttcttttttccttttaaattttttcctcttaaaaatgagatggagccgggcgcggtggttcacgtcggtaatctcagcactttgggaggccgaggcaggcagatcacttgaggtcaggagttctagaccagtctggctaacatagtgaaaccccgtctctactaaaaatgcaaaaattaactgggagtggcagcatgtacctgtaatcccagatactcagaaggctgaggcaggagaatcacttgaacccaggaagcggaagttgcagtgagctaagatggcgccactgcactccagcctgggtgacagagcaagactctgtcccataaaaaaaaagagagatgggatcttgctatgctgcccaaggtgggttttaatctctgggctcaagtgatccacctgcctcagcctcccaggtagtggggattatagttgcatgaccacagtccatcacacctggcttctcactttcttgatagtgaactgtgatgcacaaaagtttttgattttgataaattccaatttatcctctatctttctggttgtgctttttgtcttatgtctaagaatctattgcaaaatctagggtcatgtctagatatggtggctcacacctttaatccagaactttaagaggctgatgcagaaggatcacttgagggcaggagtttgagaccagcctgggcaacatacagagaccctgtctctgcaaaaaaaaattttttaattagctgggtgtagtggcacacacctgtagtcccagctactcaggaaaccaagcaggagaatcacttgagcccaggagttcaaggctgcagtgagctatgattgtaccacagcactccagcctgggtgacagagtaagaccctgtcttaaaacaaaacaaaacgaaacaaaaacagaaaaaaagaaagaaagaaagaaagaaagaaatcataggtcatagagatttacctcagagttttcttctaagagttttatggttttagctcttacatgtaggtcttttatccattttcagttaatttttgtatgtggtatgaggtaagggtcaaacttcatgttttcatatgtggttatccagttatcccagcacaatttgttgaaaaggctattctttccatattgtatagttttgacactcttgtcaaaaatcaactgaccattgatgtataggtttatttctgtactctcaattctattccattggtctataagatcataagtctaccattatgccagaaccacacagttttgattactatagttctatagtattccactttaattggcctattgactttttggctatatctttttctatagtacttttagtagtttatctaggtactataatatacgttttcacaatttactgtgagataatattttatcattgctagtaaactgtcaaaattttacaattacatagggcccttccgcctttatgttgtattgccttatgtatctaaacacactgaaacaccaacaatgttatcatctttgctttcaatagtcatgcatagtccttgtaataaacttactagggaaaaaataggctattatatctactcagatatttaccatttctgtcgctctttctttattcttgaaatcccatttccttctggcatcatttcccttcagcatgaagaaccttcattaacatttcttttaaagcaggtctactagtgacaaattatcttcattttcttgatctgagattgtctttattttgcctttattcctagaggatatttttgcacaatatggaattctaggtggacaatttttttcatcattttgaaaatatgacttcctttctttttgccctcagtggtttctgatgagaaatctgcaattgtttgaatccttgttctcctatgtgtttttctctggttgctttcataactttttaaaatcttctttaatcagcagttatactgtattatatttaatatagtttctttgagtttgccctctacgagatttcttgaatctgtaaaagtttgtcttttacctaatttacctaatttcagccattatttttttcaaaggttttttcttcaccaatctctttttcttctccatcggagatcccaataacctgaatgctagactttttgatatatagtcatcgcttagcatatataggacattggttccaggaccccgctcccccacccccctaaacacacacacccagtgtataaccaatctgtgcctactcaagtcctgcaggtggccctgcagaacctgagtatatgaaaagtcagccctccatacatacaggttttgcagcccatgaatactgcagttttgatgtgcatttggttgaaaatatccacctatttgagggcctgcgcggttcaaacccatgttgttcaagagtcaactgtatatcccacaggtttctgaggctctattcatttttttaaaaaaatctctttgctctttgttgttcagattttgtcattcctgtttatcctcaaatttactgagtttgttttctgttatctacattccgctatcaagcccctacagtcagttatttaaatttttcttattttccagttataatatttccatttgtttcttttacattgtgtctactttgctaagaacttgtatctgtccatttattttaatagcgttctcccttactttttggagtacggttatattacctgctttaaagtctttgcctaatattgccaacatttgagtcatcttaaggttggcatctgttgtcttttctcttgaaagttgatgagatttttctggttctttgtaggctgaataattttaaactgtatcctatgcattttgaatattattttaggagactcttcagaatgctgatttttggttttagcaaaccatctacctagttagattcagctcataagtccttgctcaccttctgtgggccatggttccaatatccagttagttttcaaagcccatgaagtgatatttggctctaccctgctcatgtgctacacagtgccaattggcagacaggactctacacagtagttcagttttcaaagcctttgctttgatgcttcccatcagttccacatatgtacagctcagggctgggcccaggatattattcacagattttaggagattgctttttccagtttcctcttctctgtgttttcccgcacactcgccagctcgcagtgggttctttttcccatcctctggctagaaatctaggcttttagcctcctacactgtcatgtacttcctgtgaccaagtctgcctctggggttgagcaatgagtgaaaagagaaagaaaaagcacaatagtgattctttcctggaccagtttcgtgagcaggcaaatcatgcagccacatagggtccaaccttcagaagaatctcacacttagtttaacactctgctggaaccatctttcaccaaggaaccctgcattttcattttgtactggggcccataaattaggtagccagtactgatttcccacactcttcagactcctaaagccaattttcctagtacttctgtgtagagataaggatttctatctcagatttttaggtgcctgtgtgaccactacagccactgatacaccagaatgctgcttagtgactaggacttgccttgaggtcatggcctggagataaaacaaagaaacagaaaaatagagattctctccacgctcttcatcccacaggggaccctattctaagtcatctgtccaaaaagaagtttctcttggtgttattttctgtctgtatgcaccgcatagttctaagatttgggtgtcccttgaggttaaaaactaggatgtatgggaagaagaaaatcaggaaactcaccaccatgacagtcattttttctttttgatttccttccccattctgcctgctactatttactcttcaggacctgtgcataattgctttatgtatttcatccacgatttttagttgtattagtgaaagagatattgtgaagtgtgcttacttcatctagatggaactggaagcactttgtttttagaatttggaatagtcatggacaaaagcagagtgcagcagttgagcaggtaactttggaggcagaatgtgctggaatcttgctttggccagggctactctctgaactctaattctccacctctaaactgatgacaatatttgttcagtaagtatttcttgaatgcctattatgtgcttgtgattcttagtattagttgaaattatcttaagaagaactctgctagcccagtctccaattttacagaagagggagagccccagagagagaaggtgacttcagttagatcaccagctaggaactgtgcagatgtgaataaaacctagtacgtctgactctccatccagggaccttcccactgtacgtcaacagccatttatctctttgactgactgattgtggagagagagagagagagaaagaaaggaagccagctacccagtctgagcaggccttgtgaaaagatcatttttggccttgagaatatatgcagcaaaattgtgttacagggtgcaagagctcaggttggattgtctgctctccatacaattattgtataatcatcaaacatcctcctgagcacctgctgcaacgagacctaatccagaagaaagtggaaaggcatggggaggacccaacatgacactgccctcaagcatcttccaaatgcctggaatagagagagggttagggagtttcagggctggaagtttgcatgtacgacagaaaagaattcaacagtacaagggaaaagatgctaaattccttagtaacaaatatacccattgctataggagtagaagcaggtacttggactttggataacagccctggtctacaacctgaatctgacactttctggttctgcaacttgggatcagttatctcattttcagagccttgttttcctcatctgtaaaacaagaattatggaggtaccgacttcatagagttacggtcttcacagtattaaaaaataacaaccgccaacatttactaagcccttaactgtgccattatggtgcttgtgtaattctctacaaaatttgcaaaattcagccacatgtgatgtctctcgcctgtaatcccagcactttgggaggccgatgtgggaggatcgcttgagcccaagagttcaagaccagtgtgagcaacatggcaaaactctgtttctacaaaaaaaatacaaaaatcagccgggcatggcagcacatgcctatagtcccagctcctcaggaggctgagatgggagggatctcttgagctcgggaggcagaggttgcagtgaactgtgattgtactactgcactccagcctgggtgacagagtgagactctccaaaaaagaaaaaaaaaaaaaggtaaattcatttgagcccgttttcagataagaaaacagatcagctaaatagtgcatgtagagaatgcttagcacacagcctgaacaaggagtaggagaaggtgggggtggtctccaggacaataagagcctgaggaggaaattatgggatgagagacaggaagattggtttcaaagacagaagagaccttcaaatgtccaaccggcaagaggcagactggcctcaacttggattctcttagaaccaggtatgcatttaggggaagaaggattctgagaacagaagagtgagaacctggggtgtggggaaatgcactgctggcagaaccaggaagcgctctctggtcccagctgccaccagcaccctgtgttcctggagtctcagcctccccactgtacagtgatggggttggcggagggagtctgcacaggaattaggagtttcaaacccaaatgcctttggaaggcaggtataattcactggtaggtgggggtgaggggaggtgggcctggtgaatgggaaaagaatgttgtgcctaaaggcattcatattcaattgtcgaaagactgtgctgtcaaaacaaaacgcatctgctggccagatctagctgccccagagtgttgagatctttggtctggataaaacctcagtggcccttccagctcttaagggtccagggctcatcagatgactccaggcctttctttttatctccttcctcctccttaccctcatcttcctaccttttttcctcctcttttatttcctttttttgtttaattgaagcacacctaacataaaatttactcatcttaaccactttcaagtatacatacatattaagtaaattcagattattgctttctttcatctgcagaactcttcagcttgcaaaactgaaactctgtacccattaaacaataactccccatactctcctcatgccagtccttcccaactagcattctgcctctttggacctacctactccaggtacctcatataagtagaatcaggcagtccttgtctttttgtgactggcttatttcactcagcaataatgtcctcaagatccatccgtgggttagcatgagacaaaacttccttcttttttaagggctaaataacgttccattgcatggatacacccacattttgtgtatccattttctgttgctagacccttgggttgcttccaccttttggctatgtgaatagcactactgtgaacataagtgtacaaatatctctttgaggccctgctttcagttctttggggtagacatccagaagtggaatgccatttttctttttgttcatgttactctttctccttcttacattgtgatgtttctgtaggttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggtatcttcatgggctgtcaggtggtggggactcaggaatgggtggaaacgtataggtcacttcctcctcccttccacagctgggaaactgaggtctagagagcctcccacagaagaagcagaattgtcattggaaccacggtctccagattctctgtcctgggagttcctccttcaacaacagcctcccaaattgagttaagccttgacatcttagtgtgaaggaggacatgacttaagaagagaggacacaagtgagagcccttggtctactaaggagagaagggaagggcactgggagatggcaagagacagagagaggagtcgggaggtggccacacttcccatagtcttgtttgccacagccagtggttcacattccccaagtcagagtaaccagatagaaaagtggaaaacaaaaaccaattgggccaacctgggcaacatggtaagaccccacttctacaaaaaaaatttccatagcttagctgagtatgatgtctcatacctgtagtcccagctgcttgggatgctgaggtaggaagatcacttgagcccaggagtttgaggttacagaaggctatcatcacaccactgcactccactccagcctgagtgacacagtgagaccctatctcttaaaaacaaacaaacaggccaggcgtgatggctcatgcctgtaatcccagcactttgggaggccagggtgggtggatcacctgaggtcaggagttcaagaccagcctggccaacatggcaaaacctcgtctctactaataatacaaaattagccgggcatggtggtgggtgcctgtaatcccagctactcgggaggctgaggcaggagaatcacttaaacctgggaggcagaggtttcagtgagccaagatggtgccattgaactccagcctgggcaacaagagtgaaactccatctcaaaataaataaataaataaataaataaataaataaataaataagccaggcatggtggcacacacctatagtctcagctactcaggaggctgaggcaggagaatcacttgaacctgggaggtggaggttgcagtgaaccaagatagcaccacagcactccagcctgggcggcagagactctgtctcaaacaaacaaacaaacaaacaaaacaatttgggaagaccattggaatctgtaaaagtcttatgttctagcatactcaattcatgcaatagttagcagccccatagacatcaacagtgccatattgaacagacgcatgaacccacatcccactgtgcgggattttctcccacaccaggtcatgtcattaattacaggacatttcggtcttctcaagcggacagtcacagtcccttggagacctaatttgcctaaatgtggctcctttcccaacatgataatgccactcatcaagcatttactgcatgccaattataagcagatgccaagtggcactgatgtgagtagactataaccttggaggttcactatcttcgccggctcctgatccggtgggaatgggggaggaacagatagtgtatgtacacaaacaataacatagaaaaagaagctctccagagtagcaaacaggccttggggatttccaaggaaagaaagcacatcggaaggagacaacagggaaactccttgtccggcaggtcaactcaatccaaacatggaccactctggtacacctgagtccaggtcccagttggactgcctactagcttgtggttgtagatgatttacttcaactctctgaacctcagttgcctcatttataaactggagttgtcatgaggattaagttgagctgtgtctacaaggatctggctgtggtacctgctcagaacaggggaatttcaaaaacttggaggggtttgaacagatggaaatggagtaaagagggtgcccaggcagcaggactagtgtgagcaagaaacacagaaatgtggaagttagcctttttaaggaatgggctaaacacacacacacccatttatttatttatttatttatttatttatttatctatctatctatttatttttgagacagggtctcactctgtcgcccaggctagagtgcagtggtgcgatctcagctcactgcaacctctacctcccgggttcaagtaattctcctgcctcagcctcccaagtagctgggattacaggtgtgcaccaccacacgtgggtaattttttatttttggtagtggtagggtttcgccatgttggccagactggtctcaaattcgtgacctcaggtgatccaccgccctcggcctcccaaagtgctgggattataggcgtgagccactgtgcccagcatcacacatttattaaacatggaaatgcatctactgcattagtggactgaaggaaaacagtcacatctcaatagatcaaatagaaaaaaaacttagatagaactcaatatcccttgaagcctcacacacactctgcccctagcttgaggctggcaagtacccctgtttctccttatattccaccctgactccccctaacttccacacaaccctatttataaactgtctcttcttccaaggatttgggattctgcagttctctcaactagaggcaacagttatgtgcctagagctttggggaatccagataattcctaaggactgatcacaaaggactagagtcttttagatccagggcttttggtcttagccacttatcatctgtgtctccctgggcaaagtatctggcctgagcctgagcctctcttttttaaaacataagattgagcatcagatggtagcgatttgcgaaggtgcaatacatactcaagctcaagatggtttttatttcatttagaaatgaccctttccattgtttccactgaatccagaaccgcactattttcactgcatgctctgctgtgactccctcttgattcttagaaggtccctctcagtcattttcagaaagggaaacaaaagcccaagtcattgtcccaaggtcagaggttaatgttccaaggaggccagtgtcagaacacagtggccgtggagagcagctctgtggtttgtcttgcaggctgtaccagtctgtcaagcttctctacattgccggcatcctgtgcacctatgccctgcagttctacgtccctgcagaaatcatcatcccctttgccatctcccgggtgtcaacacgctgggcactgcctctggatctgtccattcgcctcgtcatggtctgcctgacatgtgagtagaaaggagagtgcagtgttcctgctgatcttttctgagggctataaagaatcagccagatgggccggatgcattggcttacacctgtaatcctggcactttgggaggccgaggcgggtggatcacctgaggtcaggagtttcagacaagcctggccaaaatggtgaaaccctgtctctactaaaaatacaacaattaaccaggcgtggtggcacgtgcctgtaatcccagctactcaagaaccaaggcaagaggatcacttgaacatgtagggcagaggttgcagtgagccgagatcgtgccactgcactccagcctgggcaacagagcaagattcatctcaaaaaaaaaaaaaaaagaatcagtcagatggtagagggcagtcatgacaatcagcatttactgagcacttactgtattccagggaccattttaaagctttacaagtattcactcatctaaacaaccccattcttacatgtacctaattagacagatttgttggtgttcagcctaagggattgacacagcttatcaaacaataactgtaagaacttgctgcgcactctggcacatgcctgtgatcccagcactttgagaggtcaaggcaggcggattgcttgagttcaggagttttgagaccagcctggacaacatggtgaaaccccatctctattaaaaaaaaaaaaaaaaagaaagaaaagaaaatagccaggcatgggtgccccatgtttgtagtcccagctacttgggaggctagggtgggaagattgcttgagcccaggaggctgaggctgcagtgagctgagattgaaccattgcactccagcctgggcaacagagtcagaccctgtctcaaatatattaataaataaataaataaataaataaataaatcataagaactgacatgtattgaacacttactgtgtgccaggcactgtgttcagctctttctagtctagatttcataatattttattcagtcctcacaacaattatcatgaggtagaactatgataaaccctactttatgaaagagaaaactgaggcagtgagtgattaataattggccagaaagtgtcagaggtaggatttgaattcaagtcatgtaagtctagagccagtgcccttcacctccagggcagacattgaaaatgggactctaatttggcaacaggtgttgtttgaacctcacaatgttgtataaagtgggccaacatttaaaatgtgggcaatctccatacaaatgcagatttttaaaattttttggtggggctactataaaatgattgggcaaggctgggatcacattccccatcggcaacaatcagctggggctccttgacccctggacggtcctgtgcttgcctattggctgaggtcattcccactccctggctcacagcagcccccatgacccggagtacccctttctgcaagtattccaccagaggccgaaggagatggctagagattcctgtgtagagtagaggtggcccagctgtccctaagatgccttttgattgtaattgcaaaagtgtcttctttttaaggccaaattgtattccactgtacgtagaaaccacattttctttatccattcatctgtccatggaaatttaggaaattcttttttttttgcataacaaagtgttacttttagataattatcagtacaccgagtaataacatgtaacgagtttttgaattctaccatctagtaattttgattcagagaaactaaaagcagcccaaacagttatgctagtattcattattctaaccattagcaggaatggactaatttaagggtggctgctgcttcacacagattacaaataaccatttactactttttcatggttagaatcctgacattcaagaaagcactacagggaaaaaaaaaatattaatctctttcttcttcaaagaacttttttttactagaaaaaagaaagaaaaagtcaacattgatacactgatacatatgttacttcagctaataggcatgggaaaacatgacatatacccattaaatttctacgaaatacgatgtaaaaagaaaatctatagataagttctaagtctgtacaaagaagctagattttatattctctgagatgtgaagggacctgctatataatatacagaaatcatttaatgccttttcataagaatatatctcaagctgcatattcctcgagggcatctaaaatgccaatctgtggtacaggcgcttctttctcccactcttcttcatttatgcagcagttttcatggatttctgtccaggtgtcacagacaaaagccaagagactagccaagccttcacccccattctgctggaagtagttctggaggctggtcctcttcttctgaccctcctgtgccacttcagtgccaaggctgctgtgagattccagggctgcagcttccttggtcttgaactctttctccctctgcaggcagtgctgttcagtttcagttcagcagttgaagcctcagctgcttccttggcctgcttcagcctctatgtttttgctcacacttggacaccttctcagtggctgcatcttggcctgcagcagctgctggatcccctgagactggctgaagtggctgttgattttcacttttctaggccagcccacagcattcattcgacactgattttctttttttgaagtgattagttctcaatttgaccttgaatgcaggaactatccagtatcttacatattccagacagatcaaggaatttgccccacagtataaagataacaatcccttaagcctacactacacttcttcatgcattgtcaattagcatgtatgagtaaataacttggagtaatagcaaagataacttttctgaatgctttacatgaaaaatctcattgaagacttttatgtcctatgcagaatgaatcacaatacctaaaaggatagtagccttcatctccattttgcagctgaggaaacaagctgaggaaggggtgggacttgggcaaggccatacaagaatgaaccagactcctgccttccagacctgttctgttctaccacactcctccaaaggaggcctgctcaaggctcctgggatttattggtgaccaggaacatttttcatcaaatataataaaaaatgtaaaagcccaggtctgtaaaacgtcctgctaaaaaaatataatttcaaaatttttagcttttcgtgtttctttgttaggggttttctgacatgtgtataaaacctggagaagacacttctttaaagacacctcccggattttcttccaactgaagatctctttgtattataaataatttcatattctaattgtttgcaagtaaaaggttcttatactcatgttaattatttattaaaattctaggcattttaaaaaataatttatttatttatattatttatatttattatatttttatatatataaaatatttattatatataaaaatatattttataaataaatatttataaataattattatatttttatttattatttatttttattatagataaaatatataaaatatattttatttatatataaaataaataataaatttgtattatttatttatattatttatattattttttatttattaaaatgctaggcattttagaagacttctaaaaaatttgtacattgatacaaattttgatagtacaaacattgacagtttgtacattgatatattccaaacagcttgaatggttcccagcactgttatttagtgttatttattaagtaagagcttaagttttgttggatatgtaaggatccaaaatgcacctcggtagcataaagattattttaagctaaaaatgcctgaacaaaaagaagctgcagaaagaaactttgtctaatcttcttttgctgatgtaagcgggacctcctgacaaatatagctgccataaatcccttctctgggaagtttagagccagaaaagagacttagcattatcatgggaattactaactgtttaacaaattttatctgaaactgtcatatcttccatttgttcttccataaaagccctttctcctccctccttttccccttattaagggggtatctttggctgttctggaagccaattcttctcaaggctctggagcttatatatacactttgtcttttctcttgttaatcttacctattgtcagttgaattcacaagcacccaaccactgaccctaagttggtaggggaaaagtttttgaatgaatacatttcctcccaacaatatgaatgaacaatatgaatgaatacaattagacagagactcaccaaattttgttattgttgttttgagatggggtctcactatgttacccagggtgtccttgaactcctggatcctcctgcctcagcctcccgaatagctggggctacagaaatgtgccactatgcctggctgaatttttaatatgtaacttctagggaatatgattagggatattggaggacttttaacttttctttctgtaattgaatttctgagaaacaattagttcattttttaagaagaggattttttttttttttttaatgagataggacctcactttgtcacccaggctggagtgcagtggcgtgatcttggctcactgcaacctccacctcccaggttcaagtgattctcctgcctcagcctcctgagtagctgagattataggcacccactaccacacccggctgatttttgtatttttagtagagatgggatttcactatgttggacaggctggtcttgaactcccaaccttcagtgatccacccatctaggcctcccaaagtgctgggattacaagtgtgagccactgtgcctggccaagaagaggactttaagaacaaactttcaaagcttggctaagcctggaatgctccatctctccactatcctctccctgcaggcctcctggccatcctcatcccccgcctggacctggtcatctccctggtgggctccgtgagtggcaccgccctggccctcatcatcccaccgctcctggaggtcaccacgttctactcagagggcatgagccccctcaccatcttcaaggacgccctgatcagcatcctgggcttcgtgggctttgtggtggggacctaccaggccctggacgagctgctcaagtcagaagactctcaccccttttccaactccaccacttttgttcggtgagcctggcactgctccttgcctaccagcacccgacttttaattatatggatctctttttttttttttttttttttttgagacggagtttctgtcttgttgcccagactggagtacaatgatgcgatctcagctcaccacaacttcggcctcctgggttcaagcgattctcctgcctcagcctcccgagtagttgggattagaggcatagtccagcacgcctggctaattttgtatttttagtagagacggggtttctccatgttggtcaggctggtcttgaactcccgacctcaggtgatccacccaccccggcctcccaaaatgctgggatcacaggcgtgagccacctcgcctggccagatctcttttatatgcattatctttatgtcactgctttgccttttctctgggccaagtcatggtgaaacaagaaagctacaagctctaaatggtaattttttacatttttgttttgtttattacttcttcttttcatacctctggcattccactacattgtgagctttcccttggaaggctctggactctatccaagcttatgataattcacacaatgaatttcatacctagcgtggagctatgcaagaagcagccaccagagggccccaagtggcagcaactggccaaaggagatgcagccagctaagactgtccacactttggcagacaaccggttttcccttttctgggtctgttcaaaaagcaaacattaagggtgggcacataatccacaagccagaaagttgtgcacggctccagtgttgagatgggtagggccaagatgaccagtgtgaaaactctcagatagaaaggagccatgcatattaaatgaggggcaacaaacatttcaaacgattagataacattttctcccaactcaaagatcccaacaatgaataggaggcatggaagtagatgtgccaatggggagggatgaggagtgaacatgaatattatttgaatagactttacctcttaattcttgcaacatgcattcttgattacctactgtgtgccaaacaagattttgtagaatattgcaaaaatgaccataaattcctcgtgataatgtgactttgcacctgctcctatgaaaagatgaagtctgtatctgtatcccttaaatttttttgcttgtttgtcggttttgttttgtgttttgtttttttgagatgaagtctcgctctgttgcccaggctggagtgcaatggcacaatctcggctcactgcaacctccacctcctgggttcaagcgattcttctgcctcagcctcccaagtagctaggattacaagtgcctgccactatgcctggctaatttttgtttttcgtagagatggggttttaccatgttggccaggctggtctcaaactcctgacctcaggtgatccacttgcctcggcctcccaaagtgctgagattacaagtgtgagccaccacgcccagcctctcccctttaaatttgatcttggccttgtaacttgctttggccaatgggacattagtaaatgtgatgcagtcagaggtttggtaataacctatgcatcaggacttacatcacttgctgctctatggagttgagaccaccaagtaaagcatcctgggctagcctaccggaggatcagagaccatgtggaacataaatgaatcatcccagttgagccctgtccgcagatcaaccagcctaccaacttccagacacgagtaaagccatcctagactatatccaaccccagtcaggctgacacagaccataagaattgtacagataatccacagaactgtgataaataataaagatgtttgtaattttaatacataaagagtgggaagttttatgcagcaaaagataactgataaatcattctaaagaggatacactgattaatgagaaaagaatccctgctctcaagcagccagtctgctgtccattggggaagagttaacaggtaatcaactaagtaaataccatctaatgtccatctaagggcaaaggacactacctgctctagagcaccaaagaagactttccacaggtggtatcatttgagctgggctttgagtagaacctgaatcttctacgactgagcctgaaccttcttccattctgtcctgctgcctggacattacagcacctatgcttgtgtctgatcttggctggcagccagaggcaagccaacctgagacatcacctccatccttctggtggtgactgctctctcccctcccctcagaattactaaaattgagaaaacgcacctagataaataaatagatgttgaagatctatagtcccaaaaggtggggagaggagagtttctcatcaaactctccgtggtttacgggaatgagctatgcctgtttcagcctcggtgttaagagaacatttgaaaaagccctgtcctgcttattttcatccttcgtcttccctgtgccccccaattcccacgtcccggtctgctctttctgtatgttactttctatctgctggacttccagaagatacttcaccagcacaagtccactcagatggaggaaaggctggtggtccacacccagatcccatagcctacagagtccctgttgggcaacaggacactcatagctcgtgcaggggtccacagtccactttgccagagaatgggttgtcatttccaccctgagctctctgtttcatcagcaaacccaaaggacttccaatgatccatcctgagtgttggcaatgtgatcatcctctctggaaacatttctctcccaccctgctccactatcaatcaccgcacccatccttgaagtttaaagttatcttctctgttattaagaaaagtttacactcattctctaaagataagcccctactgtgtaagaggatagggttaattttattactcagacaaatctggctgaagttaaaccttggaaagaaaaactaaatttagcaacattgatataaccaacaaaactaagctagggagactcattagtaatcattggcaacactaaagactactacatgttagctttatgtctgagtggtggtgatattaaaatttcttaagtggtttggaactgatttttttagtacacacatatgcatacacacgactttcttccccccatttaacttactatttatttaacttctggaacttgctagtgagtcaaggaacatagaaaacccttcctcctttccttcattgagtgcttactaaggattttacatgagatcatctcatttaatccttacaatgacctgtgatgtttacactgtcattgtctccattttcagataaggaaacagactcagagacattaaataacttgttaaagatcaaacacgtagtgaaggatggatccaggatgcaaacatttgtgcatcaaagctcctcactgcattgtagggcccaagggaggccactgaatggtggttatcaaaatgtaaaatagggaggaggtagagcaagatggtagaaagctccactgatctgtcctgtcccccaacccctgctgcaaggacaccaatttaacaattatgtacaccttcataagaaccaaaaaacgtgggcactcacagtacctggttttaacttcgtatggctgaaagaggcactaaagaggtaaaagaaaaaacagtcttgaatcaactgcgcagcgccacccctcccccacccccagcaggggcccatggtgcccagagtatctctgggctctggggaagggagaacccagtaattgtgatgcattgactaggtgctgcccttgttatagcagaaaggaaaaccagaccaaactcagctgacacccgcccacagagggagcatttaaaccagccctagccagaggggaatcactgatcccagagatcagaactctagttcccacaggcctcaccaccatgggctaaagtgctctggggctttaaataaacttgaaaggcagtctaggccacaaggactacaactcctaggagactcctagtactgaattggacccagagacagtggactgggggagcaggagacatactgagacaccagttggggtgactaagggagtgcttggcatcacccctttcctaaccccaagaagcacagcttgtggctccagaatagaccccttccttttgcttgaggtgaggagaaggaatagtggggaggactttatcttacatcttagataccaactcagccacagaagaatagggcatgggtcagagtcatgatgctgcctttccagaccttagcttctgggcatttctagacataccctgggccagaagggaacccactgtcttgaaggaaaggacccagtcctggcagcattcatcacctgctcactgaagagcccttgggccctgaataaacaccagtgatacccagatactacatcaagggccttgggtgagactctgagacctgctgactttagttaccagctcagccacaggggtagagcaccaagtaggctcttggggtccccaattccaggacttggctcttggatggcatttctggacctgtcctgggccagagggtagcccactgccttgaagggtgagtcccaggccaggcagcatgcaccaaaagctgactgaagagccctcaggacttaagggaacattggcagtagtctagcattactccctgtgggcctgaggtggcagtggccatagggtgaggctgccctacctttggaaaggggagggaagagtgaaaaggactgtgtcttgtggttcgagtgccagctcagccacagtacaatacggcaccaggtagacttcttaggtttttgattctagtccctggctgtcaagacagatggcacctctggacctgcatacagcctgggggaactctccacattaaagggaaaaatacagacccgaatggcttgccacttactgattatagagccccagagccttgagcaaacacacgcagtagccaaggagtggttacaggaggcctctagcaagacccagtgctatgctggcttcaggtctgacccagtgcagtcatagtgatggtggtcacaagggtgcttgtatcactccacccccagcttcatgtggctcagaacaaagagagagactctgtttgggagaaagtaagggaagagaacaagagtctctatctggtaatccagagaattctcccagatcttgtccaagatgattaaggtggtacctctgtcagtctgcaacaaccacagtgttgctgggcttgggttgtgccctgaagcagatacaacttagatcacaacacccaagccctttcaaatatctggaaaacctccccaagaatgatggatacaaacaagtccagacagtgaagactgcaaaaaatacttaactcttcaatgcccagaaactgaagagcatttactagcatcaacaccatccgtgaaaacacgacctcaccaaatgaactaaataaggcaccagggaccaatcctggagatacagagatatgtgaactttcagtcagaggattgaaaatagttgttttgaggaaattcatagaaattcaagataacatagagaaggaattcatcagataaatttaacagatattgaaatcatgaaaaagaatcagaaattctggagctgaaaaattcaattgccatactgaagaatgcatcagagtcttttaacaatagaatcaatcaaccagaagaattagttagcttaaagataggctgtttgaaaatagtcagagaccaccaaaaaaaaaagggataaaaaataatgaagcacacctacaggatctagaaaatagcctcaaaaaggtaaatctaagttattggccttaaaagaggaagtagagaaagagataggggtagaaatgtcattcaaaaggataatagagaacttcctaaacctagagaaagttatcaatatccaagtacaagaagtttatagaacaccacgcagatttaacctaaacaagactaccttaaggcatttaataatcaaactctcaaagatcaagtataaaggatcctaaaagcagcaagagagaaaaacaaacaaaaacaccatggagctccaatatgtctggcagcaagacttttcagtggaaaccttataggcaaggagagagtggcatgacatatttaaagtgctgaaggaaaacacttttaccctacaatagtatatctggtgaaaatatacttcaaacatgaacgagaaataaagactttcccagacaaacaaaaattgaaggattttatcaacaccagacctgtcctactgtgtccggaattggtgggttcttggtctcactgactttaagaatgaagccgcggaccctcgcggtgagtgttgcagttcttgaaggcggcgtgtctggagtttgttccttctgatgttcagatgtgttcggagtttctttcttctggtgggttcgtggtcttgccggctcaggagtgaagctgcagaccttcccggtgagtgttacagctcttaaggcagcgcgtctggagttgttccttcctcccggtgggcccgtggtctcgctggctcaggagtgaagctgcagaccttcgctgtgagtgttaacagctcttaaggcagcgcgtctggagttgttcgttcctcccggtgggctcgcggtctcgctggcttcaggaatgaagctgcagaccttcgcagagagtgttacagctcataaaggcagtgtggacccaaaaagtgagcagtagcaagagttagtgcaaagagcgaaagaacaaggctaccacagcgcaaaagcggaccggagcggattgctgctgctgtctctggcagcctgcttttattatcttatctggccccacccacatcctgttgattggtagagccgagtggtctgttttgacagggtgctgattggtgcgtttacaatccctgagctagacacaaaggttctccacctccccaccagattagctagatacagagtgtccacacaaaggctctccaaggccccaccagagtaactagatacagagtgtcgattggtgcactcacaaaccctgagctagacacagggtgctgattggtgtgtttacaaaccttgagctagatacagagtgccgattggtgtatttacagtccctgagctagacataaaagttctccacgtccccaccagactcaggagcccagctggcttcacccagtggatcccacaccggggatgcaggtggagctacctgccagtcctgcgccgtgggcccgcactcctcagcccttgggtggtcgatgggactgggcgccgtggagcagggggcagcgctcatcggggaggctctggccgcacaggagcccatgaagcgggtgggaggctcaggcatggcaggctgcaggtcccgaaccctgcgccgcgggaaggcagctaaggcccggtgagaaatggagcgcagcgccggtgggctggcactgctgggggacccagtacaccctccgcagccgctggcccgggtgctaagcccctcattgcctggggccagcagggccggccggctgctccgagtgcggggccgccaagcccgagcccacgcccacccggaactccagctggcccgcaagcgccgcgcgcagccccggttcccgctcgcgcctctccctccacacctccctgcaagctgagggagccggctctggccttggccagcccagaaaggggctcccacagtgcagcggtgggctgaagggctcctcaagtgccgccaaagcgggagcccaggcagaggaggtgcccagagcgagctagggctgtgaggactgccagcacgctgtcacctctcactgccagaaatgctaaagagagtacctcaatcagaaagaaaaggacattaatgagcaataagtaatcacctgaaggtacagaactcactggtaatagtaaatacacagaaaaacacaaactattgtaactctgtaactgtggtgtgtgacctacttttatcctaaatagaaagactaaacaatgaaccaatcaaaaataataacaacttttcaagacttagtacaataaaatataaacagaaacaatgaaaaattaaaaagcagggtgatgaagttaaggcatagagtttttgtcagttttctttctttgtttttgttcatttgtttgtttatgcagtgttcatctgttatcaggttaaaataatgggttataagatagtatttgcaagcctcatggtaacctcaaaccaaaaaacatacaatggacacacacacacacacacaaaagcaagaaactaaagcatatcaaaagataaaaatcactttcactaaaggaagacaagaaaaaaaaagaaggaagagaaaaccacaaccagaaaacaagtaacaaaatggcaagagtaaatccttacttatcaataataacattgaatgtaaacggactaaactctccaatcaaaagacataaactggctgaatgaataaaaaacaagacccactgatccgttgcctataagaaaatgacttcacctataaaagcatacataggctgaaaataaagggatgaaaaaatatattccatgccaatggaaatcaaaaaaaagcaggagtagctatacttatatcagacaaaatagattttaacacaaaaactataagaagagacaaaggaggtcactatataatgatcaaaaagtcagttcagcaagaggatataacagttgcaattatatgtgcagcaaacactggagcacccagatataaagccaatattattagagctaaagagagaaatagataccaatagttagagacttcaacacccaactttctgcattggacagatcttccagacagaaaattaacaaagaaacataggacttaatctgtgctatagaccaagtagatctaacagatatttatggaatatgtcatccagtggctttagaatacacatccttttcctcagcacatggatcattttcaaggatagaccatatgttaggtcacaaaacaagtcttaaaacattacaaaaaactgaaataataccaagcagcctctctgaccacaatggaataaaacttgaaatcaacaacaagaggaagtttggaaactatacaaacacatggaacttgaacagtatgctccttaatgaccagtgggtcagtgaagaaattaagaagaaaatttaaaaatccttgagacaaatgatatggtaacacaacataccacaatctatgggatacagcaaaagcagtactaaaagggaagtttatagctataagtgcctacatcaaaataggggaaacttcaaataaacaatctaatgatgcatccagctgggaacggtggctcacgtctgtaatcccagcactttgggaggccaaggtgggtggatcacttgaggtcaggagttcaaaaccagcctggccaacatggtgaaaccccatctctagtaaaaatacaaaaaaattagctgggtatggtggtgggtgcctgtaatcccagttactcgggaagctgaggcacgagatcacttgaacccaggaggtggaggttgcagtgagccaagattgtgccactgcactccagccagggcaacagagcaagactccatttcaaaaaacaaacaaacaaaatgcagcttaaagaactagaaaagcaagagtaaaccaaacccaaaattagtagaaaaaaagaaataataaagatcagagcagaaataaatgaaattgaaatgaaaaaacaatataaaagattgataaaacaaaatgttggtttttttgaaaagttaaacgaaattgacaaaccaatagtcagactaagaaaatagagagaagatccaagtaaataaaatcagaaatgaaaaaagaggcattacaactgatactgcagaaatacaaaggatcattaatggctgctatgagcaactatatgccaataaattggaaaatctacaagaaatggacaaattcctagacacatacaatctaccaagattgaaccaggaagaaatccaaaacctgaagagaccaataacaagtaatgagatcaaagcaataataaaaagtctccaggtaaaggaaagccttggaccctatggcttaactgctgaattctactaaacatttaaagaagaactaataccaatcctactcaaactattccaaaaaacagaagaggagggactacttccaaactcattgactattatagaagttcagtattaccccgataccaaaaccaaacaaagatacatttaaaaaaaaaagaaaagaaaagaaaaggaaattacaagccaacatccttttgtgtgcttgctctgggtgatggtgatttccacggtctctgttttgtagttgcgagtttggctttgccttgttttaaaacaagcataacgtttattataattgatcactgtcttgtttacttgtttactgtttgtcttcctactaagggaaagacacactccttgaaaatggaaccatggtccatcctatttattgttaaatctgcagcaccttatatagaataggcatgggttaggtaagtattaaaacaacgaataaatgacatggcaaaaccccatctgttttggtttttttttaaatttttttctcgagacggagtcttgctctgtcatccacgccggagtgcaatggcgtgacctcggctcactgcaacctccgcctcctgggttcaagcgattctcctgcctcagcctcctgatttgctgggattacaggcacatgccaccatgcctggctaattttttgtatttttagtagagatggggtttcaccatgttggccaggctggtctctaactcctgacctcaggtgatctgcccaccttggcctcccaaagtgctgggattacaggcatgagccactgcacccggccacaaaaccccatatctacaagaaatacaaaaattagctgggcatgatggtgaatgcctgtagtcccaactactcaggaggctgaggttggaggattgcttgaggctgggaggaggaggtcacagtgaactgtgattatgccactgcacttcagcctgggtgacagtgagaccctgtctcaaaaaataaaaataaaataaaataataaatgcataagtgcaacaggggaggggaaattattttcaacttgagaaaaagtcttttgggcatcagaagagagagatatttcatctgatattcagaggaagagagaagctcccagtgctgattttacagcagcacaaagaggtggtgtggggagtaccttggcccccatgagcttcataagcaatctgtgcagtcatcccaaacaaacgtgcaatcaaagtccagtgctggtgcttgctctgcaaaagcagcttcaggacgcgattttgttaatgccagtcccattctttctgttactcatatcaaaaatattggagtcttccttgattcctctctcttttataccccacctcaagttcatcagcagatcctcttggctttatctttaaaagtatccagaattcagtcacttttcaccatctctttcactaccaccctggtttaagccactacagaccgacacctgggtcactgcaacaccctcctggattattgtaatagcctcctaattgatatcccttgcaccccttcaatctgctcgcaaaaaaaaaaaaaaaaatggccagagacatcctgtcaaaatgtttaagtcatgtcatttctctgctcagaaccctccatgatttctcatctctcttaaagtaaaatccaaagttgttacaatagcctacaagatcctgcccacccactccatcccgctttcattacctctttaaccacatctctggtgtgaccatgtaattatcatccaaaccaggatatctctttttattttattttattttttttttgagatggaattttgttcttgtcacccaggctggagtgcaatggtgcgatctccgctcactgcaacctccacctcccaggttcaagtgattctcctgcctcagcctcccaagtagctggaactataggtacatgctaccaagctcggctaatgtttatatttttagtagagatggggttttaccatgttggccacgctggtctctaactcctgacctcaggtgatctgcccacctcggcctcccaaattgctgggattttaggtgtgagccactgagcgtggcctattttatttcatttttagggtggtttcccaggctggcctcaatcgatcttcccatttcagcctcccgagtagttgggtctacaagtgtgcaccacctcgctcagctgcaggatacttttaataatgaagggaggcaccattagtaattatgccagggcaataggcacaaaccaggcgaatccattctcctctgtgtgctcccagatagccatatgacctcattgccattcctaaaacaccccaggcactctcctgcctcaggacctttgcacttcttgcccctctgctaggagtttcttacccaagacctacatgagttgtgttccctcatcttgttcagccctttgcccaaatgtcactttctaggtgaggccctctctgatcacccaatctaaaattgcgaccctccccctagctgaaactctccattacccttgcctggattttctctataccgctttttactaacagatacttgatatatttgtttcgtttattgtctgtctcccccagcccctccagattgtaaattccatgagaacagagattgtagtaagttttctaccctaatatattcccagcatggagaacagtttctagcatatattagatgctcaataaatattttctgaacaaatgattttttttaaacatgacctgcactcccttccaaatcactggcaggccatacgcctcctgtatagaaattctgagcaggtggcatttgaactgggccttacaagccactcttcaccccaaacagggaacatggtagctggattatgttctgttgggccacatctgcatcccaggattctgctgcagctcattggctgggcagcctccattgtgaggtagctctggttttttccttgccaaagacagacaagcactgagcctggccccacgtccaggcaccaggacctccaatccaatggtgtcttcttcctcccagtcacactgttcactttgccctacagcagcaagggctaaactaggagaggccaaaagcccaggcaagtcctggttgggcaagcaattgcgagtgaaactgaggaccatcctgactgagatgggtctttcataagtcccccaagagccaggtgaggcatcatcaacatcagcctctcctgccaccaccgcttccctgattcatgcacttcaggcttcagccagcagcacgcatccttggggttaggagccagcatctcaggtcagcagccatggtttctctggagaaagacccatcagaggctcattcagagccttaaccctgagcctctgccacctacccaccgtgttgaagatgtcattgcttggaagggactacaacagtgagctgaactccttggacaacggacctcagtcaccctcagagagcagcagtagcattacttcagagaatgtccatcctgctggagaagctggactatcgtaagtggccgcaccgcccttccaggcctgaggtcaagcactgctgtttttgcaactctggactatgtcttccttcatctatctccttaacacgcttattccattaacacgatatgcgtggataaaagatgaaaccttcagaatctaaggaggtcaatccctgtggctctggctactagccctgtttcccagtttttacgaagaacccagctagagcagccaccctcaacatgagcagcttgtctccaggaacagtttcctatctcaggctgtctgccctttccttcctccctttctttcttccacagtctctggctgccttcttctcctcacacatctgccattattctctctgcctcttctccccaaccccccatgccatccatccagaaaacaaaaggtgctaaccccatgtctccacctttactgccccaaactcagacacatggaactcttctctctttttttttaattaaattaaatttaatttaattttaagttccaggatacatgtacaggacatgcgggtttgttacataggtaaacgtgtgtcatagtggttttgctgtacctatcaacccatcacctaggtattaagccccatataccttagctatttatcctgatgctctcccatcccctgccccccacccccaaccagccccagtgtttgtcttgttctcctccctgtgtccatgtgttctcattgttcagctcccacttacaagtgagaacatgcagtgtttggttttctgttcctttgttagtttgcggagtatactggcttccggctccatccatgtccctgcaaaggacatgatttcaacagaactcttcttctaggacttactgtcaatcacactgctatctggtaatcatcagatcggtaacaactgtgggcacaaagagattatcgatgacaatccccagtgttgataaggatatcaggaaatgccctctctcatcttttgggaagaattaaattggtatctttctagatggcaatgttacaggtcaaatcgtaaaatgtcatttgtataaaacatacaaatatttatttggcaaatgctgtctgaaagtatacaactcgtgcacacacacaaaactgacagcagtggttgcctctggggaagagaatttggaggctgagagaaaagagatttatatttgtttcataaggatttggattattgcgttttatcttttgaattttgtactgtaagtattacaatctagttctttaaagtataatgaaatataaataaatataccctttgattaataatacccctctaggaattttttctgatgaaataatagcacaagagtgcataatttttatcaaagcacttgttataatgtaaccactcaatgggttcaccttgcccactgcctagacagagacgatttatcaagacaggggaattgcaatggagaaagagtaattcatgcagaatctgctgtgcaagagactggaggttttttttttttttttttagacggagtcttgctctatcgcccaggctggagtgcagtggcgcgatctcagctcactgcaagctcgagaccggagttttattatcactcaaatcggtctccctgagcattcgggaattagagtttttaaagataatttggtgggtaggagcttgggaagtggggagtgctgattgatcaggttggagatggaatcacaggggctcgaagtgagtttttcttgctgttttctgttcttgggagggatggcagaactggttgagccagatgaccggtctgggtggtttcagatggtccatcagagtgcagggtctgcaaaataactcaagcactgatcttaggttttacaatgtgatgttatccccaggaacaatgtggggaggtttagactcctggagccagaggctgcatgacccctaaactgtaatttccaatcttatagctaatttgttagtcctgcaaaggcagaatggtccccaggcaaaaagggggtctttttgggaaaggggtgataccaatagtcaaaccatgaaatgaattccttcccaaagttagctcagcctatgtccaggaataaacaaggacatcttaaaggttagaagcaagatggagttggttaggtctgatttctttcgctgtcttaatttcctcagttataattttgcaaaggcagtttcaataatattgaaaacttggaaacattaagagaaaggttaacacatgaaacaaacatacagtagaatatgatacagtcattacaagtgatggaggaaatgtatggacatggaaagtgtgtagcacatttattcatacagaaaattagttgaggatccagcatgcatagcggttctctttatgtaaaattcggtgcatttagagcaaataaagatgcccagaggagggctaattataatgtgtggttattttccattggtgggattttggaatttccttttataatagcaattgtatagttttcgagaaaaaatataaacccaattttttaaatctcaggggagcttgcaacatctatttatgcttcaaggtccagatgggtaaatgctgtcagctaaggcacagtggttcctccgaaaacttgtctcacctttcccacaatatctgattcaaataggggcaagacatcgatgctgtcatgggaaagaagtgagagacaaaggaaaaaagagcagagggtgggaaatgggaccacatcttttggagaaattactacttaagaattgacaaattacagttatcaagaaataaaggttatctcttggaagtaaagggacaatgggtgcccacccccccatccttaggtgaatagactgccctaacagaagttaggtcaatagacttcactcaatagactgaagtcacagaagtccccaacagttcatctgttctctcaacccaaccctctctcaggtcagcattgaaatgcaaagacctggttggttacagcttcttcctagccccttgccatgactctctaatggataagacaaagagatgtgagcactgtctctgctggactcacttgggcagttggttttggctctcctggccacctgcagacaatttaagtgtggcaagagggcattctctgtcttagcctgagacttcgtctgtatctcccaatggcatcttcaaggtacccttttgttcttgggtggagggggcacttctacttgcttaaaccagcccatgcttgcctttttcctatcatcccaattcttcttcctcttgaaggatgcgctttctaacaaatgagcaccatgaaggccaaaccaaaggtggcagtgaggatgatgatgatgatgagacaatgatatgacgatgatgatgctcacatctgtgaagcacttcatgattccatgattcatcatgttgttacctcttttgagtcttacagcttccctgggacataggcaaaactagaattttctcccttttttggcagtgaaacaggatcaaagcagctaatggcttcccaaagtagtaaccaaacacagtaggttagcggcagagctggaactcagaattaagtgctcccatctctgggttcaatgcttacgcatgtactttttatttaagttcctttttgattctgttctcatgatcctgttcccacctttcccacccaatccacatcaggattggagctgcctgggcaggagctgccagcacaggtgtgaagaatatttagaaccctaggccctagcaccctgctgggaccatcataagtactctatatgcacagtaacaattgctattaaattattaaattttacccagtgcataatgtcgatatatagcaattcatatatatataatatatatatatatatatatatcaccatgctcatctgactctactttgccacaattctccccacagtcctccccactccctagcatcacatgcagctcatttcatatatatatatatatatatatatatagagagagagagagagagagagagagagagagagagagagcgcacaagcaattcatattcacaatgaatattggttgaacaaatggatgaaggagtaaactaaaaccagtaaatatcccatatatggtagatttttgtttctagtgagtgagttaataaataacctgatgtctcactgtagactgaggcaactattactaatttttccattgtctatctaactgatagacatgtattaggtcacaataaatgttatttgagagaataactcatgaaagaaatcactggatgaattaatgaaccaaccagtactagagtgttatccagaatggtagcaatttttatttcctttagagcctagtgtgtattaaagatttgttgagtcacttgaactagcaccatccccagatcagatgttccaggacagacccctagaactgagagttgtctccaagtccacctcatcaggttttgcccctcttcctatcaggcgctctggagatgccagaaggaggctgagtttctggccatgcttcccttccactaacagtaccctctgtctccctactctccccaccacaggatgatgcaaactttgatccacttgttgaaatgcaacattggcacagggctcctggggcttcccctggccataaagaatgccggcttgttggtaagaggcatctgtgggatgggaactaggtttgctcatttgcagaagggggtgataggtcctgaaggccttcacactgttatcaatgggcaatttgggggtaccctctgcaattgaaaatgtgcctgttggcatcaatcccctggagtcaacctgggtccaacctgagcatccctgaagggggcacaccattactcttaaagactcaccatgctcatctgactctactttgccacaattctccccgcagtcctccccactcctaggatcacatgcagctcatttcgtcatttgcattaacagcccaatccctgcaggcatttgagtgtgtgactcctgttccaaaccacttgagggcgcatgagaaagtgtcttggacatgaagatagacgcctccatcaatcccaccaatccactctccccacaccagcctacctctttctcttttcctgtgctgttcctgccccctcatttctgtctttttaaagtgcctcctctctaaaactttacactttcttatgatcactaatgccatcctcactttgtatttttctaccatttatatctaccttacctgggattcttaaagcacttacgaagataagatatttatttatttattattatttattgagacagagtctcgctctgtcgcccaggctggagtgcagtggcacaatcttggctcactgcaacctccgcctcccgggttcaagcgattctcctgcctcagcctcccgagttgctgggattacaggtgtgagccaccacgcccagctaatttttgtattctttgtagagaggttttcatcatgttggccaggcaggtctcaaactcctgacctcaggtgactggcccatctcggcctcgcaaggtgctgggatgacaggtgtgagccacctcgtccggtcgacatatttattttctaacagacccaccttcctcatttaattgaaagctctgtgggcaagaactgtctgatttccctttgcacgtccccacggtagcctctgtagggactggcacacagcaagtttccattaacatctactgaatggaatagataccaaatatataattccatttccttggagtgaatcttttcttatctccaggcctggtaagtggcttctatgtctaaagaaggcgagacccttgctgcctctgtcatgacttctgatcttcagtggttccaacccagagactggactctcccctttggaatcctctgggttctagagcttctacaaaaaaacatggtcttcagccaaactatctttgccagggtggtatttgtttttaagacaatgcttttattctttgatatttgcttcctcagagtcattagatgatttctttacctttcatctcccaccagaacctctggccatgattcatttgagaaatatttattgagcacctatctaccctgtgcatttgtagcccctgggaatatagaagcaaacaagacacgagagtctctgctgcatgaagcctgcattccagtggagtctagtggtgctcttgatccctcatttatgtctttgtgataggtcacatctataaagacacaagtgttcagaacaaaggatgtgagagggtccccgtttatacccttctgatcacctctggaagatataattagtaatcagccccactttttaaaaggaatttgacaaattagacacactacagtagtgatccccaacttgggatcattttgcaccagctcctgctaccctagccaaagacctttacaatctctacagacatttttggttgccacaatctgggggaagagtctctgacacctagtgggtagaggctcgggaaagctgctaaacatcctataatgcaaaagacagctcctgataacaaataattatctgccccaaaatgtcaatagggcacctgttgataaactctgtactagaggaagagaactgagtcataagaacaccttggccctcaatcatcttggaggaagtgagggccagggtgtgtcagacaaaataaatttaccacaagggactctaaactggtagaactcaaggaaaatgagaaaatgcatgggctatgtgggaaggtaatgagctctctgtcactggaagtatcctagcagaagttgggcagccactctacagggatgctaagaagagcattcaaattctagcatctgggagcatgaggacattcaggctgggtctgtcaccccaaagacagttttattatgcaacaggccccagcacgcagactgtgagagggccagggaatgggagtgatcatttctggctcacttccccctttctcctctcccctccaggtcggtcctgtcagccttctggccatcggggtcctcaccgtgcactgcatggtcatcctgttgaactgtgctcaacacctcagccagaggtcagaggcctgcttctctctcattccagcactggggcccctctgagggtgtgttgctcttcttttgaccactgacccaattaattcggccactgctccaggccaccttcctaccaatctggattctatgaaggcaaggagagcatgacagagagtcccagttagagactctaggcacagatccaacgctgctgctaacaagctggatgactgtcaaattcctgcatccccctgagcccagatctccttaactgaaagcatcgaaagtgataaaagatgcaaaagcactatataaattactctatttatttgagacagagactttcttctcttccttttagcctctccatccccaaccttctcccactccaatacccacaccttgtcagggtaatttggtccatgcaatgttagtaaaagtaaaaagcatacttactgaaaagaagtcttcacaatgatttcagtcattatcaaagcatacttataataatcaatgtttatgtatttgaaactttaatgcaaaaacaatttcagaaagaaaagacaaatgcagtaaaaacaaagaatgcagagatccacagcgctcagctactcccaaggcatgcaaaaccaaataggtcctcgtaaatgtgaagaaaggtctcaaaagtcaaagtagggacggtaaacaaaactctccataaagcctaattatcataacccaaataggtgtacctggagtacatatcagtcacacctaactctcagagcactttcctgctcacaaaacgcttttaagagcatttactcattccgtagttaaatgtattgtgcaattacactgcggttatcgtgccaagagccttgcaagccttgtttactcctcacagtaagtctatgataggcactatttttattcccattttacagatgagtaaactgaggtttaaatgccttgcccagggtcatatagctgggaagtggcagagccagtattcaaagacctactgtgactccactgttaaccattttgcaaatcttctcttccctcaagccttctgggatcattatatcaccagataagcttctgacatcaggccatttctgaaagcctttctctgattttttttttttctctgatgacttgtcttttattttttctaatatagaggttgcagagtgatggcctgagagttggctatggccttcagttatgttttgggggacttcacagttttattttttagtcaatgtttaaaccctggagatttcggccgggtgcagtggctcacacctataatcccagcaattcaggaggccgaggcaggcagaccacctgaggtcaggagttcgagaccagcctgaccaacatacagaaaccccatctctactaaaaatacaaaattagccaggcgtggtggtgcatgcctgtaatcccagctactcgggaggctgaggcaggagaatcgcttgaacccgggaggcggaggttttggtgagccgagatcgcacccttgcactccagcctgggcaactagagtgaaaactctgtctcaaaaaaaaaaaaaattcacattcacaaaatgtgaattggagatttcacattcacattcacaaaacaaaaaaatctctgccttcttaatcagttagacaaccgactgcttctgagccttcattttttagatgtgcttctagaggcaactcctgagcaatcccttttacaatgggatgtgttattctggtttgccacagtctccaatgttccctactgtctcttatactcagcccctgtcacccaccagatcaccagtacctgtctgatcccatagcttctgaatttgcaaccctcagattcatatccttgccagttctatgcaaggtgacttcatttgtattgaaaatgcctatcacggtgagcagtaacaaaaatgtcatgttccagcacatctctatatccgtctctcactgtctcttcccccaaaatccagactgcatgtgaagaaaactggggcccagagatctcaagagactggctctacatgtctggctacctgagggtcatgttgggatttaaactctggtatctgaagaaggctggagcccttcctctctcccacctgttcccctcagtcctgcaatttatgccgtgcttccaggatctgggcaacctgctgctgtttccacttgctccagccaaaggtgtttctgcagcagggcctgctccacccttaaaagggttgagaaagagggacatggcaagaggaataggctggaacttgggcatcacatcctacagggggctgggcaggatcccgagtatcacctttgtgaggggtctggcccaggccaggatctcgagtgttctgacaccatcagcaatgggaaggagggaatcactggcctggccacacccacaccacctcttcccctccctcctcctctccccctccatatcccctttcctgctttgcagatctacgtcaatgcacagctaccgcttactcaagaagaataaatccaatgatagtcagttaaatatttgtgcttaaagggataattgcaaaaaaagaaaaaaaggcaaactcctgaaagttgttaaagtataaagtagatcactgggagaaaattgacagaaggcttcatgctcacacacaaatacataaaaatcactcactttgggagaaaactgtacctttaacaaaaatgttttaaattatgcattgtttgttctttccccctagactgcagaagacttttgtgaactatggagaggccacgatgtacggccttgaaacctgcccgaacacctggctgagggcccatgcagtgtggggaaggtagtagtcacagatgttgtagtagtaacaacaaaaatcatcatatcacttttctttatttctacttacacaggttttaaatgaatatgctcttattgtaaactatcaaacaatagagagaatcacctcgataaccccatcccccatctcactctgtacccataaggtaatcattgaaacctagttagtaaatattcctttagactttttttctctacatgtacatcaatatatgtgtgtgaatggaagtacataatttgctttctattttcttatacattacttaggataatttctgaaaatttgatttttcatctaacaatatatccctattttttcatgttggaacatataaatgaacctcatttttggggggggagggacagagtttcactcttgttgctcaggctggagtgcaatggcgtgacctcagctcactgcaacctccgcctcctgggttcaagcagctctccttcctcagcctcctgagtagctgggattacaggcgcccaccaccacgcctggttaatttttgtgtttttagtagagacagggtttcaccatgttggccaggctggccctgaactcctgacctcagatgacccgcctgcctcggcctcccaaagtgctgggattataggtgtgaaccacctcgcccagcctacctcattattttttaaggctcacagtgttccctagtgtggatgtatatccgtttcatttgcttattcccctaaggtgaacattcaggttgttccctgccttgataaaaagttaacggtgtacaaaatggttttctctgtcttagttcctctgttcctctcaacagccttgtgaggtaggcagggtgggtttttattgccctggaaatatgaggcttataaagataaaataacatatccaaaggcatggacattgatatgggtggagcagagatttgaccaagaacctaacattggagccttccccagcaaagtccctcaggaggtagtgagtcaaattgtggctgctaagattcctttgcagctcctctcttgggattctcagtaggtcattgatctcctgatcaggagccactctaatgattagatgaggtcatgagaaagagttagaaacatttaaaaaatatttaaagtaataatttgtcatctttaatttactgagagatacctgaggagcttgattaaaaactgcccattccttggccatgtgtggtggctcacgcctgtaatcccagcactttgggaggctgaggtgggtggatcacctgaggtcaggagtttgagaccagcctgaccaacatggcgtaaccctgtctctactaaaaatatgaaaattagccaggcttggtggtgggtgcctgtaatcccagctactcaggagactgaggcaggagaatcgcttgaactcaggaggcagaggttgcagtgagccgagatcgcaccattgcactccagcctgggtgacagagtgagactccatctcaaaacaaacaaacaaacaaacaaaagctgcccattccatggaggcaatggtcattaatggatgctcaagctgttagaggaatggtcactgggaagctttataaagggagaatgcactgatgctacctgaccccatgtactcatcttagcatctcatatttatatacatgacagctagctatgtgtgtctcataatagcccacagtagggagtacagagtagtaccacctctgatatttcaaaaataaatttgaaacctccatttattcaagccactagatctaatatccatttataggaagcacgggggatagaggaacaagataaatagcatcatgaggaagtcaccaaccaaatagaaaaaataggatatactacaggacaaatgatctggtatcttcagcagcaaacaaaaaattaaaagttgcaaggaaaaaataaacagggcaaggggaatgtagcagtttaaaaaacttaagagacttaacaaaatacaatgtgtagacttgtttggaaaccaactgtaagacagatatttttgagagaattggagaaatctgaatatggactgaatattagatggtataaagaaattattggccaagcacaatggctcatgcctgtaatcccaacaccttgagaggtcaaggtgggaggatctcttgagaccaggtgtcaagacagcctaggcaaaatggtgggaccccatctccacaaaaattttttttaaatagccaggcctggtagcacacacctgtggatccagctactcaggaggctgaggtgggaggatcacttgagcccaggaggttgaggctgcagtgagccatgactgcaccactacactctagcctgggaaacagagcgagaatctgtctcaaaaaaaaaaaaagaaattattgttaattttgtaagacatgatgatggtatgatgattatactttttaaagttattatctattacagctacatactgaattattattattattattattattttgagacagagtctggagtgcagtggcgcgatctcggctcactgcaagctccacctcccgggttcatgccattctcctgcctcagcctcctgagtagctgggactacaggcgcccgccaccatgcccggctaattttttgtatttttagtagagatggggtttcaccgtgttagccaggatggtctcgatctcctgacctcgtgatccgcccgcctcggccttgcaaagtggtgggattacaggcgtgagccactgcacccggcccatactgaattatttacaggtgaaataacttggggtctctggtttgctacaaatacaccgacaaattcagtatgtgtgtgatggggctgaagagatagagaacaagtggcaaaaagttcattgttgaagctgggatgagcacatgtgaattcatgaaattattctcgttaaattctcgttatattcattaaattattcattgcttttgtatatgtttgaaaatcttcctaagatagacagaaaaagatattattctgaagtcacatgtgacactgccaagattctgactcaataggatgatatgagaaccaggagcctgtatttttaacataggcctcaaccaacaaattggttgatactacaagccaattttgaaaagcccttatctaaacattataatctaagtaaaggaacatatttttgttcttttagaaaaatgcatctccaaatttggaataatttaagaacccaaaagaataatggcaataacagagtataagatattaaatttagaaataattaacatgtgtctgttgtgatgccaaaaaaaagaggagaaaacaatatatctctcttaaaaaccagctaataaatttagaagaaatgatacatagacttagaaaaccaccaccttgcaaccaccaatgattcaagcaaggaacatcagtgagtggtaaaaccattggtttgaggaacaggataatcatgccatctcaaagttttaccccacagattacaaagggaaaatgtacatttccaataggagatctggcagtcaccaacaaagcaaaacaacaggatatcatgtgcctcccaatatgatgaaatagaggtacaaaactatcacctctgtagtattcttgctaaaagtgctcccctgaatttaatcacgaggaagcaatcatacaagcccgcaatgtggggcgttctataagacaattggcctatactcttcaaacaaagccagtgtgatgaaaacacactgagactctgtctcaaaaaataaaataaaataaaataattcagtgtgtagctctaacagataataactttaaaaagtataatcatcataccatcatcatctcttacaaaattaataataatttctttttttttttgaggcagattctcactctgtttctcaggctagagtgtagtggtgtgatcatggctcactgcagcctcaacctcctgggctcaagtgatcctcccacttggctagagatgtagccaaatgcaatatacaaaccttcattagatcctgaattaaaaaataaaataactacaaaaggtactttagagagaattgggataatactaactcatttttatgtaagagacttgagcatctgcagattttgaatttgtaaggggtcttggataccaatgaatgagtgtatttaaaatagaaactgtatatatgtataaaatagaaactgtatatatgtatatatatgaagatattgaagttgattttctggctattgcagtcttaagaatttagggtttaagtattaggatacctacaattgactttttcttttttttttttttgagatggaatttggctctgtcacccaggctggagtgcagtggcaagatctcagctcactgcaacccccaccttcagggttcaagcaattctcctgcccaagcctcccgagtagctgggatttacaggtgcctgccaccacacctggctaatttttgtatttttagtagagacggggtttcaccatgttagtcaggttggtcttgaactcctgacctcaacgatccacctgccttggccttccaaagtgacctgcaattgactttcaaatgattctgaaaaaaattgcgtgtgtatgtgtgtgtgtgtatagacgaatattcattcgtctatatatacatatatattatatatatatgtaatgcaatttggggccaaaaattaacaactggtatatttagttaaagggtacatggatgttaattatactattctttcaactttttggcttaaaaatttttcaaaataaaagaaagtagggaaatttttaaaaataataacaaaaataattgtttcaaatagtaaacattcttaagaaataattttagcttttgtttcctccctctgtctgcctcttcctttccttcccaggtacactgtcagcttcttattagtcatcacccagctgggcttctgcagtgtttattttatgtttatggcagacaatttacaacaggtaaagagccctcttctgggcagagtgggggaaaagcagacctcctgctgctgaggctacattagcaaaagtattgtgttaggctcatgggaggagagaacttcatttctactcctagatcagaccacgcttgggagctctctcagtcctgggaatcacattttgaaaggatagacgagctaaagtaacttctgaagagtttagccagggtagaaagagaggcctgcaatcatgtccagtcagaaatcaatgataattgttagcctgaaaaacactggtgacatttactttgagtatctcaaggttgtcatgtagaagatgtctaactatacaaggacaacaagctgccaccttcccctcattgcattcctatcagacattacaaatcaaccacagccttctttcttggctttgtggattagagggagcatccttgtttttgcgcacccaaacagccagaaagaactgtgacaagtattgtagacggaatattcaagcagatggatactgaccaatatttagagcttcccagattttagggctatctaaatttgaagaggatattcttgtgtgatgaattccctttctctggatgtatgaaagaaactcattttgtggagaagaaaaggtttgagtagataacaacctcaaagccttgagattttatgattctaagggtttctggttgtcacaatcatgggcccgacagggttgcccaatttggcaaataataatatatgatacccagttatgatagaatttcagataagtagtgattttgttttactatgagcgtgtcttatgcaatatttggggcatatttatactaaaaagttacattaattacctgaaattcaaatgtaattggtgtcctgtgttttacgtagcaaccacactgcctgtcattgtgctttatgtcagatggtggaaaaagcccacgtgacctccaacatctgccagcccagggagattctgacgctgacccccatcctggacattcgtttctacatgctgataatcctgcccttcctgatcctgttggtgtttatccagaacctcaaggtgctgtccgtcttctcgacattggccaacatcaccacccttgggagcatggctctgatctttgagtatatcatggaggtctgtgccatagggaagaaaggatcagggtcctgggtctctgaaacacctggggaggagggtttgttatcatgatgggcaggtgaagctgaggaaggtgatcctctgctctgagcagcccctgccaacatgacatctaggaacacttctgtcccacaagttgtaaaagctaattattatcatcatcattgtcatcaacatcctcatcatcatcatcatcgtcacattggataataatgggtcattcaacaaataattactgaataccttctgcaatccaggcattgtgcaaggggccagggactcagtggtcagcaaaaataaatagggtgcctgctctcatggaagctgcatttacttggagagataaacatcaatcaaatcaccaaaaaaattgtaaaagtggtagatggacaaaagaaatacagatgataaaggaattttatttacttggtgccaaattatttacatacattaacttattgaaccttcgcaatactattttggaagtaaagctggcactctgtatccatgatttccacatccatggatctgaacaatcacaaatggaaactattgggagaaaaaaacactaaaaatatacaacaataaaaaatcatacaagttaagaaacaactaggtctaacaactattggccaggcacagtggctcacacctgtaatcccagcacttgaggaggctgaggtgggagggttgcttaagcccaggagttcaagaccagctggacaacatagcaaaatcctgcctctacaaaaaatttaaaaattagtggggcatgatggcttgcacctgtagtcctagctacctgggaagctgaggtggatggatcacctgagcccatgaggtcaaggctacagtaagctatgatcacaccactgcattccagcctgggtgacagagcaagaccgtctcaaaaaaacataagcatgggttatatgcaaatactataccattttatatcaaggacttgagcatttgcagatttggtatccacgggaggtcctggaacattagttctcccatggagaccaaggaacaactatagtatctttatctgcaatttacagacaaggaaattgataaagtaattctttcatgaatttcagactgcctcccatgtccatgctccattatcacagaccacgaaatcccaccattatactttcattttcttgagtgaaagtctctggggttgtattcatttcatattgctgctgtgataaattaccacaaatctagtggcttgaaaaaacacaaatttattttccagtgcttgagtctcgctaggttgaacttaatgtgcggcagagcagcattcctttctggattccaggggagaatctgttctcttgtcttctccagctttgtagaggctgtctgtgtgccttggctcaggccgccttccatcttcaaagctagcagcctcaagccaagtctttctcatgttgccttccctctgatcttccccttctgactccctcttccacttttaaggatgcttgtcccacccgaataatccaggatcatctccttgttttagggtcagctgattggaaaccttaatcccatctaaaaacttaattctccctcgccatgtaacataacatactctcatcttttggggattaggatgtgaacatctttggggaaccattattctacccaccatagaaatctattaacataatcattccccctagattcatgagagctgctatactaactagtggactgcacagccctgaaagaagtgtgggagagacatgttagagggctgggaaacaggagacctgaattcttatctgggctgtgccactaacttgcatagtgaccttgggcaattcccctctcctctgtgttccactttctccacatgtagagatgagcgggctcccagtagccaaagggtgggataatccaagagtccaagtaagtgatgaaaggatgaacacgatttggtgtctatatatagagtggaatattattcagccttaaaaagtgaggagacagtgacacataccacaatgtggatgaaacttgaggacgctaaagctaaatgaaataagccaggcacagaaacaatacatatgataggattccacttacatgaggtacctagaatagtccaattcatagagacagatagtagagcagggggtgccaggaggctgggtagtggggcgttattatttgatagataaagagtttccatttggggtgatgaaaatgttctggagatggataggggtgatggatacacaacaacgtgaatgttcttcatattactgaactgtgcacttaaaatagttaaaatggtaaaatgttatgtgtattttagcacaatataaatgaataaatcatcatatttaaaagattagaaggctgactgaggtctaggtatcttctgattttctctgttgagatcaggtgtgacccagctttctaccaggcaaagatttgggatgacttcgacaccataacaacaccaatgtgcttctcccactttcttttaggggattccatatcccagcaacctacccttgatggcaaactggaagaccttcttgctgttctttggtacagccatcttcacatttgaaggcgtcggtatggtaagattgatggggttcacgcgaatggtccctagcgccctctacagtggccaactgtagttgcagatgtctgaataaatagtatttatgaaaaggtgcagactctgatcttctcctggtgaagggaaagtctgtacccacatacagggtccctactgctctaatataccacgctaagcattgaagactgagaatttactaatcaaccaagactaagtagggcattcctgacaatagaaagcatgagagaaaatgaaaggagtgtggccatgtggagagtcccctttctgatactgggcccacctggggaaggacatttgtgcttgtacgggaaccctctccttcacaatgggccacatctctttctaccttttctttcccaacttttttttttccctccaggttctgcctctcaaaaaccagatgaagcatccacagcagttttcttttgttctgtacttggggatgtccattgtcatcatcctctatatcttactggggacactgggctacatgaagtttgggtcagacacccaggccagcatcaccctcaacttgcccaattgctggtatgtcctgcccacctcaggtgagatagggagagacactggaactgttctggttgtcatagcagagagcacagcaaagctgagccatgaagctggtaatccatcactggaagtgacatatgtctctcctgctcacactgcatcagtcaaagcaagccacatggccgcacctcactccaagggggcagggaagtgcaattctgccatgtgcctggaagtatttggtgaacagcacaaataactgctgtgctacctgatgcagtgaccgtggggattaattggattaatacatagataatgcttagaaaagtgcttagcacgtggtaagcattcatgagcgttagctattatcattgttatgcatccccacagccttcatttttccaaggtgagtaggatgatggtgcatttatttcccacaaatccagagctgtagaatgagaaaaatgtaaccatccccacccaccttgctgtgttatgataatgactagatgagacaataaatgtggagtttctttgaagttgtgccttattttactcaagatatcatcctaatatgctgttcttgttctgggcaatttgggctgtcactagctgccttggacagggcactttccttcctgggacctcagctagaaaacatgggtgttgagctccatcaggacttcacacctgctggtgtgaacctcactagtcatcaggttctccaggaaagccttaaacaaatatcccttcccaataagaaaaagaccaaccacccaatgagaaatgggcaaagggcagaacaggtatttcacaggcaaataaaaaaaaatggccagatggccagataaagagatgctcagaaagatagtagaaggccaggggcagtggctcatgcctgtaatcccagctctttgggaggctgaggcgggtggatcacctgaggtcaggagttcgagaccagcctggccaacatggcaaaaccccatctctgctaaaaaatatcaaaattagctgggcgtggtggtgtgagcctgtaatcccagctactcaggaggctgaggcagaagaattgcttgagcctgtgaggcagaggttgcagtgagccgagatcacgccattgcattccagcctaggtgacaaaagcgagactcagtctcaaaaaaaaaaaaaaagaaagaaagaaagaaagataatagaaatgtgagttaaaaaataaatacaagggcaaagatgcatgcatcgacacactgtttaggcaaggacatgggaaagcaggtctttttatacactaggacagcaaatgggcaatatgtcaacagctattaaaattttaaatcatgtagacttttacccagcattttaacttctaagtttttatattatatgtgcattaatatatgtacaaggatagtctgtgcagtattgtttacttgggaaaagtctaagcccaatctaaatattcattaattggtgactgatttttaaaatgattgcatatccatgcaattgacatatcaaccagctattaaatagaagagccagatctatgtgtactggcagggaacaatctttaagacatactgggtgagacagccaggcgtggtggctcatgcctataatcccggcactttgggaggccgaggagggcgtatcacctgaggttgggagttcgcgaccagccagaccaacatagagaaaccccgtctctactaaaaatataaaattagctggacatggtggtgcatgcctgtaatcccagctactcgggaggctgaggcaagagaattgcttgaatccaggaggcggaagttgtggtgagctgagatcgtaccgttgcatcgcttctcagccttttggctaagatcaagtgagatcataccattgcactccagcctgggcaataaaagcgaaactccgtctcaaaaaaaaaaaaaaaaaaaaaaaaaacaagaaaaagaaaagaaatattgggtaaataaaagaggagtctacatgtgtatgtgcatatgtgtatgcatgtgtgtgtgtggatatgcatgtatgttcctacattctgtatgagcatgtacaaacaccaatcatttctagaagggccacaagaaaactctgaatggttgcctatggaaagggaaactagaagctaggaatcaagggtgggaagaatgcttttcactgtatgacttttgtaccatgaattttactctatgcatatattgtcttttttgtttgtttgtttgagatggagtctcactctgttgcccaggctggagtgagtgcagtggtgcaatttcggctcactgcaacctccacctcctgggttcaagcaattctcctgtctcagcctcccgagtagctgggactacaggtgcatgccaccacgcccagctaatttttgtatttttattagagacgagctttcaccatattggtcaggctggtgtcgaactcctgacctcaggtgatccactcgcctcggcctctcaaactgctgcgattacaagcgtgagccaccacgcccggctattgtcttttaaaaaattaaaaaagaagaggcatacattcctgagctgcaggcctactgactcagaatcttcagcaataagcacttttaataagcttcccggatggccctgatgtccaatctggcctgaatcatctaacattagccagttctataattcagtgaaaagtacagattgagtaacccttatccaaaatgcttgggaccagaagtgttttggattttgaagcatttcagattttgttttggattagggatactcaacccataccagcttctgagcagtaagtgagtcctcaatggcccttccggggagccacatcacctttcacatccaattcatgtgtctgcaggttgtaccagtcagtcaagctgatgtactctatcggcatcttcttcacctatgccctccagttccacgtcccagctgagatcatcatcccgtttgccatctcccaagtgtcagagagctgggcactgtttgtagacctgtctgtccgctcagccttggtctgtctaacctgtgagtagcataaaagggcactctttacccaaagctatgacagggagccacgctggcgcccaccccaccatcattggatctgccacttgccttctttgtgacctagggtgggatatttcacctccctggacctcaatttttccacgtgaaaaaaaagggcttaacagaattaccacacagtaaatgttatagtcgtctctactgcctacacatagaaaatagatgctggctggtttgtagaagaagtatcattcattcaatcctatatgtcaggcaccgtactgacattatccaatactgatgatagcctaacaatgtattaccattagagggaactgtggcccagataaattaagtaacacacctgagtcatacacactaagtgacaaagctgggatttgaacacagattgtgtaacaactgtttttcatggtgccatatttcttcttatcataaattatgaacaagtcctgtatcataaagtgagatttaactgtagggaaaaatcccagtgggactgatttgtcagtcttggagattatttatttatttatttatttgagacagagtctcgctctgttgcccagactggagtgcagtggtgctatctcggctcactgcaacctctgcctcccaggttcaagagattctcctgcctcagcctcctgagtagctgggattacaggcacctgccaccatgcccggctaatttttgtatttttagtagagacggggtttcatcacgtttgccagctggtctcaaaatcctgatctcaagtgatctgcctgcctcagcctcccaaagtgctgggattacagatgtgaaccatgcacccagccagagatcattttttggctgtactcttctctcttccctcccttcctttcttcctgttcctttcaattcattcattcactcactcatgagcactgttgtagtgtttgggaaacctcatgaacagggctggggaattctttctttggaacatgtctagacggaggatcacaaacgatgacccatgaggaatgagcaaaacaacaagggatgttttgcctggagaagcaaagtctcaggaaatttccacatttatccttaaacacctgtgggattattgtaaaagtgaagggagaaatttagtcttcaaggctccaggagtcagaatttaaagtcattgaaggaatcaagtttccgtacggggtcaggagaaactatgcaatgcttggagctgtgcagcagaacatactatcagataataagctttaaatggcaggcgttctatgagcagaaacagcaaaatcctacttggtttgaggtgttagagttcccagtctgtgctgagacatcaggaagctgtaaatagtattgtttgtgatcattcctactaggaagggtgtaagttgacaagaaagactgaggagcctctgagtatcagggaatgcatgactagagacagttgaccttataatgacatgtcctgcttttgatatatgctgaaagtcccattcttcatccattattcatccatcaattctattaccctttaccctttattcattcaacaatcatttgttgagcacctactacatacctggcattgtgctagacacaagggatacaatgatgaataatgaagaagatgtagcttctgccttcacaggacctacagttgagtggcaaatatatgcaaggaaataattacagtgcattgcaatgattgttaagatgggacatgataatgcaccatatgatggttaagatcgtaagtagaagacacactctacacataagggggtcctataactcagcctggccgagccagggagtcctctccagtggagtgacacttcagtgaagacctaaataagtagcaaatagacggaggagtgaagaatgtaccacgggaagggaacagactgtgcacagacctgaggcaagtattgcctatggcccctttggagaagtggagagtgctgagagatgaggtcagagctttgtcagggccaagtcctaagggtcattgtgctgaggagtttgggccatgcagagccatggaaaggcactgagcagaggactggcatgaccagaatggagcgtaaggcctttctccattccaccttgaattatagcttttcttgcatgtatcttctctgcctcctcgttgtgagctttcctggaagactgatgctgagttttctctataagcggcttattaaacattggatgaaggaaagctgtggacagggacctcccatcgaaggagaatgcactcctagccatgagagtctatgagtctctcttatgcttggactggatgtgtcagagcaatttcagaaagaggtgatttttttaaagatccagcaagcttgtatggatgctttccagaacaggctttctctattttgttcataggaaaatcatatgattggaatattttaagtaatggatatcccaagtacactgatttgatctttactaattatataaacatattgaattatcacatgtacccccaaactacatacacatagtatacatcaatgtaataattgttttaaaataataaatttgcataaaattaaatcatataaattatatatttactcattcaaacattattgaaattggactcccttggaaaatctgtgatactatatgctcatcatgtgtataagagatggaattttaggagtgtgaagagaagagaaggatgggggttggatagcttaatgctgtctttgtgttttatggcctgcttcattactaagatcctattaagaatagaaaaataagtggctgatattcggacagcagcagaagcatctcccatttttttatccatccttgcttctagacaaaggctatattatatagatactacaaatgttggttctgagcctgggcaagagtcaagcacttattgagcatctactgtgtatcaagttctttcttacacatgagaggcagcatagtagagtgaaaaggaccttagatggggcatcccagtgaattctcatctcagctctgtgtgaccttgaacaagtcctgttccttctagagctctagatttccccatctctacagtggggaggttattaacaggtaagtggtagaagagcccttccaataaagattatatgtaaaaaaaaatccagtagataaaatataaaaggagagcatctatattactagttaagacaggggtgggagttgcctgacctccccaagcctgcagtaggctccctcccacctctccaaagtggtctctcaggtgtctgtgaaattctagggctccaaagcaatggcttgtttctgagcacattcagtgattctaaatatctcctttcattgcaggtgtctcagccatcctcatcccccgcctggacttggtcatctccctggtaggctccgtgagcagcagcgccctggctctcatcatcccagccctcctggagatcgtcatcttttactctgaggacatgagctgtgtcaccattgccaaggacatcatgattagcatcgtgggccttttagggtgtatatttgggacataccaagccctctatgagttgccccaacccatcagccattccatggccaactccacaggtgtccatgcataattatctgtttttattctaatagctctcccttcctcccatccccagtttgacttccatgtggatgttatataccttcatcaaatcccaacatctctatattaattagtggcgtctttatctttccaagagaaatgcagatgagaaaagttagcactgatgtctctcaggctacacctcttttggttttatattttttggatggccttttgtacctctgaaccaaaattagattcaactattcatattatcagcctcattttatggaaaagggatgccacttaccccaatagcccttgaaacagagaccaagcataaatacaaaagtaactgttttctctacactgcagtagctgcccttaaagcatcagatttagaaaagtgtatgttgggcgaagggagttttctatttagatattctaagtagaagagtcatagacagaacaaaaacagaactcagcagtaattttgtccaaccactggctccgccactgatttcctactggccctcaggcaagttcctccccatctctcagtctatgaagtgaacagttggactaactgattattaaggactctgtcaactctgatattctgaaagtgaataaaagaaattaacttatccaccaaccacaaaaactggccatgctagtgttggtgaggaggtggagtaactgaaactccataccctgctatgtggatagaaagtagtacaatcagtttgataaacatcttgtagtttctttaaaacttaaacatatacctaccatatgatccaactattccactccagaaaaaagaaatatatatccataaaaagacttgtacaaaaatattcatggtaactttacttataaaagcaaagaagttggaaatactctaaatgtctataaacaagagaatggataaataaattgtgatgtagccatacaatggaatattcctcagcaaggaacagaaacaaactgttgaaatacacaataaaatgtatgaatcttaaaataaatatgctgaatgacaaaatccagaccaaaaaaagaatacaaactggatgattctatttatataaaagcctggaaaatgaaaactaatctgtagtgacagagaacagctcagtggttggtgcaagatgagatgggtgagagggaggtgttacaaaggagcatgaggaaatttttggaagggatggataacatgttcactgtcttgattgtgaagatggtttcacaagagggtacatatgtcaaaacttatcaattggatacttcaaatatgtggcatttattatatgtcaattatacctcaataaagctgttaaaaatagaatatgaaacatgattccatttttattttttaaatcagttacacacatacagtcaaataattttgaatactcagcacattgtcataggaatttttcaccaagtgggttgaattatgagtaaaatcttacactttttattttatgtatttatatatttttaaaaatagagacagggtctcactatgctgcccaggctgatctcaagcccctgggctcaagcgatccacctgcctcggattcccaaagtgctgggattacaggtgtgagccactgtgcccagccaaaattttatactttttcttttgcttgcctatgttgttgcatttttaaaaaaaataatgcactgatttcataactaaagaaaattcattttaagggggaaagtattaatgatgatttgtttcactctagaagaaatgccacctttaaaaagctttttatttaaacaccaatgaaagtataactctacagtataattaatatttgtagagagtatcaattttcaacttcaccttctattagatgattgatattatggcctgaataacaggcatttcagctggagttagcagcattccccctctgtaatgtatcgtccatttaccaatggtcagatgccaaacaacagcctctcagaggagatgtgaagtagctgtgttatcatgaaggagaggtagggaagaatatcctaccgctagatagaaagctatcagcccataaaaagtttctgctcttttgggatccagaccatgaacttggagaaggaaaggctttgaggaacatatggaaaccttactatagaatatggagcaattaaacggaggtaaggcagctgtttatgatttttggggacttatgcagctcactgacattctaatagaagctgtggctcctccttctataaaattcacatatatgcataagttttgcatgcagtttctgaaactatcacaaacctcatgaagtgaatagaccctgggttgcaaaagaacctctggaaaaaaaaaaaaggaatgtaaggatttctgcttctcatacatgaaatgatctgcagatgatagatagccaaccctggaacaaaggtctggatgcagaatagagcaatatacaaaaatcagatgagggaggtaagctatcagataagagatcaccatgtaactggtatagaaaacactttctgatggcagtcagcactgataggacccaaactggtcattccagttgtgcaacacaggctgaattctctgctgccacatgcttctttggcaaaaactgggacttatgagttgaaacagagagatctagaaggatacaaagaatgtgggaaggtcccccaggaccttcagaatcatttgccactgtacttctctactggacaaatatgatttatcttgacatgactgagctggacaatggttggggcataaagggaaatgatatataaaatcaatcagtttaagaagaagctgaattcagatcttcaacaaggccattggaggccaggcacagtggctcacgcctgtaatcccagtgctttgggaggctgaggtgggtggatcacctgaggtcaggagtttgagaccagcctggccaacatggtgaaacaccatctctactaaaaatacaaaaattagccaggtgtggtggcaggcacctgtagtcccagatactcgggaggctgaagcaggagaattgtttgaacacaggaggcagagggtgcagtgagccaagatcatgccattgtactccagcctaggcaacaagagtgagactccatctcaaaaaaaaacagaaaacaaggccattggaaaaaaaaaagaaatgggagagttgagattgctaaggaacacaaactgagattgctaagcacgtaagccctacaagtgtggggctagagaagtcacccacgtgaaggtgaagccttaagagatagctacaaagtgatataagtcagtgcacaagtgcagtggtttataagccacagtgccctgggaatggaactgacaggcagcaatctaaggatctataagacttgttatccgccaagtccaggttgtgcctgtctcaaacccacaaaggagctccttaagcaattcccagatctgagttcaaaagggaagaaaaagggggtggggagcagaacacctccctggcatgccaaccccaattgcaagtgaaatttatttggcaagatagactctctcaagggaaaattctcaggtggattcaaacttaggaagttggcttcctggtcagggagacatgggtgaaccaaaagacttctcccgggaggccgaggcgggcggatcatgaggtcaggaggtcgagaccacggtgaaaccccgtctctactaaaaacacaaaaagttagccaggcatggtggtgggcacctgtagtcccagctactcgggaggctgagaggagaatggtgtgaacccgggaggcagagcttgcagtgagccgagatcactccagtgctctccagcctgggtgacagagtgagactccatcgcaaaaaaaaaaaaaaaaaagaaaaaagaaaggcttctccccacctctccagcttcttcttgccccaattacaccttttccttccagccacaccaaccagcctttgtccagttccgcaaatgcaccatgcttcccattgctgctgggcctccatctacgctcttctcccatctcttcacctgcttaattcctcctcattttccagatctcagctatcacttcctcaggaaaaccctttctgacctcagccactaacccagattctgcataaatgttcactcccttctcctgtactgcagttacatgatggcaggttgtgttggttaatactgagtgtcaacttgattggatacaaagtattgatcctgggtgtgtctgtgaggatgttgccaaaggagattaacatttgagtcagtgggctgggaaaggcagacccactattaacctggatgggcacaatctaatcagctgccagcacggctagaatataagcaagcagaaaaatgtgaaaagagagactggcctagcctcccagcctacatctttctcccgtgctgaatgcttcctaccctcgaacattggactccaaggtcttcagttttagaacttgggctggctctccttgctcttcagcctgcagatggcctattgtgggaccttgtgatcaagtgagttaatacttaataaactcccctttgtatatatttctattagttccattagttctgtccctgtacagaaccctaatacaaggttcatatctttttttctcaaaatgaaaacttctgcaaactatttttaaaactttttattttgaaaaaagttagactttcaaagggtggcaaaaataatagtttccatgtacccttcacccagctcttactaatgttaacatcttacataaccacagtacaattatcaaaaccaaataattgacattgatgaaatcttatttctggtcctttttctaatccaacatctaaatcggtatctcacaatgcagttagttatcatatttctttactctcttccagtccatgactgttcctcagtctttccttattgttcacggccttggcactttcaaaacgtactggccagttattttgtagagtgtctctcagtttgggcttgtctgatcttttctcctgattgcactgagattgcacatttctgacaacaccacagaagtgacaattgtgcccttctcagtgcatcatattggaaggtacatggtatcagtatgtcttattagtggtgatgttaacttgatcactgggttaaggtggtttctgtcaggcttattcactataatgactgtttttccctttgtaattagtatcttgtgaagggatcttaaaaccatgcaaaatcgtgtttcccatcatacttctgttcactaattcggcattcataggtgtttcttgtctgcaacaactattcctatggtgtttgcctaatggtgtttttttgtttgtgggtttgagatggagtctcactctgtcacccaggctagagggcagtggcacagtcccagatcactgcaacctccacctcccagttcaagcgattctcctgcctcagcctccggagtagctgggattacaggcacgtgccaccacgcctggctaactttgtgtatttttagtagagacagggtttcatcatgttggccaggctggtcttgaactcctgaccccagatgatccacccgccttggcctcccaaagtgctgggactacaggcgtgagccactgcacccagccattttttctatttctatcgttccttctacatttgtgattccattgtgtatgggattctatagtgtatttttagtcagtggactataacccattattgtcattattttattgctcaaattgcccaagatttggccactgagggacattcaatttggttcctgtgtcctttcaatatgtcccccatgttctcattacctaccatatatttgttttccccatcctaatacacacataaaatacttcctgaattactaacttctgcttctgtgaaaaatttgctaactagactctggtatttgtgtacagttccttttctctttctagtatcccatcaaaatgctataacttcttatttttcttgcccacctccttcaatgtggttgtattatgcatctgaaatacagttaagttcatttgttactgtttgtatttcattttgaactctcctcatatcctggttgactttaattattttggggggcatgagaaacattactatggctccaagactcacagttatacaaaatatactcagatacactcggcagtgttccatcccttcctcctttacaccgttatgatttctcccttctttctactctaaacccacctaccatccatagacagctcattactttctggccaatctttccttatttactttgcataaacaaatagatacatgtgctttcttacatctccttctttcttacatacaaagtaccactttctactttttgtactttgctttttgcatttaatatatcttgaaaataactataccgattcatagagatcttcctcattttttttatagctcaataatattccatcatgtgggtatgccattggtgccatggtttactcaggctttctcgtgtatatgaacatgactttgcttccaatatttgcagtctcagtgctgcaatgagtaatcttgtgcatctgtatgtttgtactgttggaggtgcatcttcaagggaaattcccacagtggaaatggttgtgtcaaagggtaaatgcttctgcaatttgttaagtactgacaaattcccctccagaagtcataccagtttgcattcctaccaacagtgatgacagtgtgtttccctatagccttgcctaacagaaatgtgttgttctttctttcaccagtcttagagatgataaatggtatctcagtattatctcaatttacatttctctaatgagttagtttgaatatttcattttaaagagccatttttatatctttacgtgagtatgttcatgtcttttcccagtttttctatcaagtttttggtcctttgtcccttaatttttaattccttatatagtaagaacactaactgtttgtctattatataggctggataaatttttctcccagtcatttgattttattgtgtttttactaagcatttttattatcttcatgtagtcaaatgtgtcaatattttgttgccactggatatttccaccacgtttccttctgtatttatatggcttcattttcttacatttggatcctggatccagatggagttcattcttgcatatggtgtgaagtacaggtctaacttcaactttctccaaggggctttccagttggctcagcaccatttattaaagtctgctttgacctgcgattgaagatgccacctttaactcctcatcccccacccctaagaaacctcacggaacatatgacccaagagcagagcagacataaaaagattaactgagctactgagattcggtcaagaatgtgaactaaaaatgaactgttgagaataaggctggaagatccaacagagggaaacggctgtggaggtcattgccaggtgaggtgtcagatccccggcattgggaagtggtcaactcgtgggttggtaaaaagaattcaccaacaacagtataggtttgaaaaaggaaaggtattagaagaatgctgcagaagactgccatggggcacctcggtgagaggactgaatgtaccacggtggatttttccttagggatatttatggaccttaaagcgggaccgtggggttgcagtgagtttcagcatggcattccggagatgtacagaaattttagttacttctaaggtttttttcggggaaaagaaatctggaaccagatgcctgctttagataataggaaagtctaattacttttaattttccccaaataaggcgttttgcctctgcatggcctgatagtcaccaggtggtctttgctcccttttaaattcctcagataaaaagattttgtctctgggacctgttcaatggtcactaggtgatttttgctctccgcagtcatgatgtgatggaaagcaaaatagcaaacaagggagctggatggcgatgaagcagagacaacaagcaagctcaagctcctgcagaagggtccgtccctggaatcacctcggctcacctgtaccgttccaacaaacccttccaaccaaaagagccccaccccaaaaatgcttttgaaatcctgagatgtgatcagtgaaatatgcagccaaggcaaggggaaactgtccgcaagttaaaaagatttattgctattccaggcttcaaatgagcccagaactcagggctggtgtgtgtttcagaagttgttatgatgtaacagggtggtagaaaaatccaggcagtttgatgtcgaggccaccctctcttccttggacccctgctccaaaagcagctgctggtgaggctctttcccatctgcctcattcacccaacaggactccaagactgaggcaggcagccttgtgatccccacagctcacaggtgagaggctgctcatacctctcctagcactggaagagccttgtccttgggaccggacactatggctttggccctgtggagggagaaacggtgccacaggagttgtcttaagaggacaaggcatgcacggtctgagatcagaggttgtgacgtggccacccatgagccagtccgtttgggacacatcacactgcacagctttttaaaaaaataattagctgccaatcttttaaaatggtaagatttcatatacaaatctggatttttggcttctctaggagtaaacattgaaactttttttttgagacagagtctcactctgtcaccaggctggagtattgccagtatctggcagttgtcttcacagactggctatgcactctccaactgactccagtccttgccacccttaattatatttccaactggagaccaggcctcagcagccttgtatcaatgggcacatgtgctgtgactttctgtgtaagaaatatttacattgtaatagcatctttaatcaaaaaggaaaaatcggctgggtgtagtggctcatgcctgtaatccagcgctttgcaaggccaaggtggacagatcacgaggtcaagagatcgagaccatcctggccaacatggtgaaaccccatctctactaaaaatacacaaattagccgggcgtggtggcagggcctgtagtccaagctacttgggaggctgaggcaggagaattgcttgaacccaggaggcggaggttgcagtgaggtgagattgcaccactgcactccagcctggtgacaaagtgagattctgtctcaaaaaaaaaaaaagcgaaaaatcgaaatcaagcctggaagcaacatgtttctcacggttcttatcagtcatttaagtctcttgctaggccctgcgggtacctgagtttgtaaacaacagagcactcctaatatctcccccaagggattcctcccccacacaccctacctctccaggatacactgcaccctagtattaattgggcaaatctagaaaggaaataaaaattagtcacagaagttaagggaggaatagactaagagcaaatacttttgccccttcattgtaacagggggccggaggagaacaaaaacgttaatactctcacttcgcttttaacttagtgacaaaaaaaaaaaagagtgaaagagagagagtcataaagattcttcaggtcctaaaacactctggttcccattccttaactgctttggaaatgaacgaggctctttagagagaatgttaacggggatgagtaacgtggtcagcccagcagatgccctgggctatcaagaactgtccaactcattctcccttaggtcagggctgcttgccccagcctaaaatgtaagtggtacaaaatgattttcagtgagggtagtggactcactgtagaaaggggattaaaggggggcagagagtgggagtttggccttggcaaacacaaaacagaggaaaagggaccttcctcacaccgctccattctgctgtggcagatgccatgttatatgccctttagagaggcagcgatcttgatgcagcccagacgcttcccactgctgctcaggacgctctctatgcggtagttcccggtggtgagccaactgggcagctccaggtcaggcacaacgaattcgctcttgggcagtgagtaggttccctgcgggaaagccagtggaccgccagtcagtgggagcctactgatggggtctttctcctagagccactgctaggattgcagccatgaactaccacccctcttcccattctcaaaacagccgcacaagatgagagacggccatagcactgtagagcatggattattatggataaagggccctgaagatcacatctaagttcaagtctcccatttcgtagatggataactgaggctcccggaagataagtgattcctgataggtcacactggcttacaaatccagagacatgcagatctgcagaaggagaatgcaaagacccttctctccaaaccccatctctttagccacaggggtaacgctctctcctccc

SEQ ID NO: 27 - DNA, 3042 bp, Homo sapiens
attgccaacttatgtactaaaatgtaccaatttatactacagtaacattttatttcggtgcctgattttctatgctattatcagcattaattattaatttaaaattttttgtcagtcattttagtttttgttttaataattgattgagaatctttttgtgtttctttgtcatttgaatttcttctatgcctgcttgatcatgctcagagtatggtttttatatgtatttcaagtacaaggcatttttttattgttggaaaagcctctttttctcagtagtttttttttttttcttctttttttctctgtagacttcctctgtggacatctcagtagttttaagcttagtgtcagtctctctccctttctattttaggataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggtaagaaagtggacagaaagccagtggggtggttagttactgatcatcattaaaaagtgaagttcaagccaggtgttgtggctcacacgtgtaatcccagcactttgggaggctgaggtggatggatcaccagaggtcaggagtttgagaccaacctggccaacatggtgaaaccttgtctctactaaaaatacaaaaattagctgggtgtggtggcgtgcgcctgtaatcccagctgcttgggagactgaggcatgtgattgatgttgtgaggtttagggaacaagacccatatatgagagagggaaaaggagagagggagatatatcaggttctttaaccatcagatgcttagacttttgttggaatttgggtgagcttctcagtgggtaagtgaaaaatcatttaccaagcttcaaatgtaattccacatgtattttttattggagcattacttttattttaccagatctttttgtttgtttgtttgttctaaccaggcaatcttcatgattcctacaaatcctcctcccacattccgaaaaccagagctatggtcagataactttacagattttgtgaaacagtgtcttgtaaagagccctgagcagagggccacagccactcagctcctgcaggtatgaatcaccctgtgatgccatctcgctccatttcatttacttgctgaccaaaagatgccatgaggtcacctacgtggagatagtaaagaagtataaggcaggctgggtgcagtggctcacgcctgtaatcgtagcactttgggaggctgaggcaggtatattgcttgagcccaggagtttgaggccagccagcatggtgaaaccatgtctctacaaaaagaatgcaaaaaattagccaggtgtggtggcgcatgcctgtagttccagctacctggagctcaccaaacattgtggcagctataacatgttcccaacatgtttacacaagttcctccaggagatgatactccctattgagaatcgctagatttgacagagagaaatggcataggcatttcagccaggctgaaaaagataggcaaagactgaatttgctctactcagagttataaagcgagtgtggtttagctgttgtccgaagcacaaagagaaagatcagattcgttgattgattcaacacatgttatccagtacctactgtgttccaggtactgttttggcactgtcaccatataaactgtctccagtattttctactttgttcttttagcacccatttgtcaggagtgccaaaggagtgtcaatactgcgagacttaattaatgaagccatggatgtgaaactgaaacgccaggaatcccagcagcgggaagtggaccaggacgatgaagaaaactcagtgagtggcagccgttgctgtgggcctcagacattgatgcttgttattttatgattgccaaaccaggtaagatgagtaggaggtattggatcaacttggagctggagatgcttccagcataactatgtcctaacctggatcaacgcatgctagagggttgttgtatctgtgcttattcttctcccagtgcttcctaaaacacttttaaattttactctttgcccctcttttactcaatttaactttttattttagagagagaatgctcaggtctgggacttggcttttcatatccttttggggaatctgggatccatacttaacatgtagcttttacatttatagacttcttcacaaccctgagattccaaagatgttcacatgagtttcttagatctatgtcacaaaactctattaagaagagtagaggaagaattcctttagggttagatacactgcttattatcacgtggataaatttgtcttctttgcttaagtaacagcgctttcatttctggaaggtgagtttaggacctgaataagtgttaaatctcgaaatattttcactaagacaggtagtagttattcagaaaactcaaagtcttttgtcaaattagccccaatttgagattgtatccttttacaggaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagtaaggctctgagtaaattcactgacttcttagaccaagcatacatatttcagagaagacagattctcatggttcatgcaggcttagccttgggttctttcttttgtcacaaccaaaggagtagaaaacttggaagtttgcgatggggacaggaggtttggtgagggggaaagctggcctgtggagtcaaagtcaagaaagcatcaacagtgagaaagaattttgcttttgaaccagagcagccattttctcattgaatgttgttattattttccttccttacct

SEQ ID NO: 28 - protein, 207 aa, Homo sapiens
DTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREVDQDDEENSEEDEMDSGTMVRAVGDEMGTVRVASTMTDGANTMIEHDDTLPSQLGTMVINAEDEEEEGTMK

SEQ ID NO: 29 - DNA, 793 bp, Homo sapiens
ctccccttttgaaacccttaataaaaacttgctggtctgagacttaggtgggcatcacggtcttaccgatatgtgatgtcacccctggcagcccagctgtaaaattcctctctttgtactgtctctctttatttctcagccagctgacacttatggaaaatagaactaacctacattgagatactgggggcaggttcccccaatattctgccatgctcggattttaattgtaagtgtgttcccctctggggcaagtggaaaccaggttatcttcttccactgcaggttccctggccatcctcatcccccatctgggcatggtccttacccagatgagcttggtgagcagcagcaccctgcccctcatcatcctgtgcctcctggagatgactacctactactcagagtgcatgagctccctcatcatcaccaaggacgccctgatcagcatcctgggctttgtgggatttctggtggggaccttctaggccctccatgagctgatccagcctcaagacctctcctctttccaaactccactggcaccttgaaacagtgaccaattttcaactcaacatttcccgcttcacttcctaaactgacattactagccttgtttgaacaaagatccttactttaattgctaatgtgtatatttatatggggccaccacagtgttgggtggagagtacaggagtgggtgtcagaggatctgagttctattcctgagatctaccatttacccccatcagatctgagtgggccacttccccttgggagcctcaacttcaca

SEQ ID NO: 30 - DNA, 805 bp, Homo sapiens
ctccccttttgaaacccttaataaaaacttgctggtctgagacttaggtgggcatcacggtcttaccgatatgtgatgtcacccctggcagcccagctgtaaaattcctctctttgtactgtctctctttatttctcagccagctgacacttatggaaaatagaactaacctacattgagatactgggggcaggttcccccaatattctgccatgctcggattttaattgtaagtgtgttcccctctggggcaagtggaaaccaggttatcttcttccactgcaggttccctggccatcctcatcccccatctgggcatggtccttacccagatgagcttggtgagcagcagcaccctgcccctcatcatcctgtgcctcctggagatgactacctactactcagagtgcatgagctccctcatcatcaccaaggacgccctgatcagcatcctgggctttgtgggatttctggtggggaccttctaggccctccatgagctgatccagcctcaagacctctcctctttccaaactccactggcaccttgaaacagtgaccaattttcaactcaacatttcccgcttcacttcctaaactgacattactagccttgtttgaacaaagatccttactttaattgctaatgtgtatatttatatggggccaccacagtgttgggtggagagtacaggagtgggtgtcagaggatctgagttctattcctgagatctaccatttacccccatcagatctgagtgggccacttccccttgggagcctcaacttcacaaattcagttaag

SEQ ID NO: 31 - DNA, 17 bp, Homo sapiens
atgaaaagtaaggctct

SEQ ID NO: 32 - skipped
  Intentionally omitted sequence.

SEQ ID NO: 33 - DNA, 1045 bp, Mus musculus
gctaatcattgcttgctttggtggctatggataacaactactgaggctgtatttacaatactttagaacactgacagtatcttaaaatatctcaaggttgtttcttcttttagtaaagatgatgtctgcaaacaccgtggctaaagtgatgatcatcatgctggcagtctgtcttcttacccaaacggatgggaaacccgtgaggtaagtgctgcagcccattgtgcacagggaagtgtggactcgaggctttgtagtgggttttaacgttgtgggcatggggagctaatggaacggtccgctctttctcttctttctaggaagagagctgtcagtgaaatacagcttatgcacaacctgggcaaacacctggcctccatggagaggatgcaatggctgagaaggaagctgcaagatatgcacaattttgttagtcttggagtccaaatggctgccagagatggcagtcaccagaagcccaccaagaaggaggaaaatgtccttgttgatggcaatccaaaaagtcttggtgagggagacaaagctgatgtggatgtattagttaaatcaaaatctcagtaaatgctgatttattctagacagtgcagggcactgacatatgctgctaccttttcaagcttatgaagatcaccaagtgctaatacttctactgtaatgaaactttggaatttttttgattacatttttgctcatttaaggtctctttcaatgattccatttcaatatgctcttctttttaaagtactactcatttccacttctctccttaaatataaataaagctttaatgctcatgaatcaagtaagcagtgtttcttgttaaaactttgtctcagttggagggttggctcagaagttaaaattgcaaactgtagggctggagagatggttcagcggttaagagcactgaccgctcttccagaggtcctgagtttaattcccagcaaccacatggtggctcacaatcatctgtaatgggatctgatgccctcttctggtgtgtctgaagacagcaacagtgtac

SEQ ID NO: 34 - protein, 482 aa, Drosophila melanogaster
MTERQPLLLQSDASDYEGSRGSAARPVRSSPPDNTLVNVHSEDSLAASGSGDDEIGSTDKSYNPTHHRDLEHPTSNFDTLVHLLKGNIGTGILAMPDAFKNAGLYVGLFGTMIMGAICTHCMHMLVNCSHELCRRFQQPSLDFSEVAYCSFESGPLGLRRYSMLARRIVTTFLFITQIGFCCVYFLFVALNIKDVMDHYYKMPVQIYLLIMLGPMILLNLVRNLKYLTPVSLVAALLTVAGLAITFSYMLVDLPDVHTVKPVATWATLPLYFGTAIYAFEGIGVVLPLENNMRTPEDFGGTTGVLNTGMVIVACLYTAVGFFGYLKYGEHVEGSITLNLPQGDTLSQLVRISMAVAIFLSYTLQFYVPVNIVEPFVRSHFDTTRAKDLSATVLRVVLVTFTFLLATCIPNLGSIISLVGAVSSSALALIAPPIIEVITFYNVGYGRFNWMLWKDVLILIFGLCGFVFGTWASLAQILNDRTH

SEQ ID NO: 35 - protein, 449 aa, Caenorhabditis elegans
MSVSSYDTARGNELLPLRGSHQPTMGEMFASRVRDSRSITADQALIHMIKVMMGTGMLSLPLAFKHSGIWLGLILLCFICLICIYCTRQLIFGQHYITFIKREQRMDYANVMRSAVELGPAWIRGHGYLFKQMVNINMFVAQFGFCCVYFVFMADNLKQFFDQTSSIHISQAGWIALLLIPISALCTIRELKALAPLAAVANFVYIIAVVIVLADLFSDWQPLDSLPAFGAVENLPLFFGTVMFAFEGVAVVLPIENQMNEPIHFITPNGVLNTSCILVLLVYMTVGFFGFLRYGNDIKDTLTLNLPQTPFYQAIKVMFVLCILVSYPLQFYVPMERVEKWIKRKVVEAKQEPMIYAIRFGGVLLTCAMAQLIPHLALFISLVGSVAGTSLTLVFPPLIELLCSYSKQELTKWVWIRNIGLMAFAMVGFTTGTYASMVQIIEAFGKEDI

SEQ ID NO: 36 - protein, 1050 aa, Rattus norvegicus
MATLLRSKLTNVATSVSNKSQAKVSGMFARMGFQAATDEEAVGFAHCDDLDFEHRQGLQMDILKSEGEPCGDEGAEPPVEGDIHYQRGGAPLPPSGSKDQAVGAGGEFGGHDKPKITAWEAGWNVTNAIQGMFVLGLPYAILHGGYLGLFLIIFAAVVCCYTGKILIACLYEENEDGEVVRVRDSYVAIANACCAPRFPTLGGRVVNVAQIIELVMTCILYVVVSGNLMYNSFPGLPVSQKSWSIIATAVLLPCAFLKNLKAVSKFSLLCTLAHFVINILVIAYCLSRARDWAWEKVKFYIDVKKFPISIGIIVFSYTSQIFLPSLEGNMQQPSEFHCMMNWTHIAACVLKGLFALVAYLTWADETKEVITDNLPGSIRAVVNIFLVAKALLSYPLPFFAAVEVLEKSLFQEGSRAFFPACYGGDGRLKSWGLTLRCALVVFTLLMAIYVPHFALLMGLTGSLTGAGLCFLLPSLFHLRLLWRKLLWHQVFFDVAIFVIGGICSVSGFVHSLEGLIEAYRTNAEDMATLLRSKLTNVATSVSNKSQAKVSGMFARMGFQAATDEEAVGFAHCDDLDFEHRQGLQMDILKSEGEPCGDEGAEPPVEGDIHYQRGGAPLPPSGSKDQAVGAGGEFGGHDKPKITAWEAGWNVTNAIQGMFVLGLPYAILHGGYLGLFLIIFAAVVCCYTGKILIACLYEENEDGEVVRVRDSYVAIANACCAPRFPTLGGRVVNVAQIIELVMTCILYVVVSGNLMYNSFPGLPVSQKSWSIIATAVLLPCAFLKNLKAVSKFSLLCTLAHFVINILVIAYCLSRARDWAWEKVKFYIDVKKFPISIGIIVFSYTSQIFLPSLEGNMQQPSEFHCMMNWTHIAACVLKGLFALVAYLTWADETKEVITDNLPGSIRAVVNIFLVAKALLSYPLPFFAAVEVLEKSLFQEGSRAFFPACYGGDGRLKSWGLTLRCALVVFTLLMAIYVPHFALLMGLTGSLTGAGLCFLLPSLFHLRLLWRKLLWHQVFFDVAIFVIGGICSVSGFVHSLEGLIEAYRTNAED

SEQ ID NO: 37 - protein, 486 aa, Caenorhabditis elegans
MASNRFQNLQNWTNKHVFSNSLDYWNQELNEVPSYQNQPQTGESGSNPPPHDRLEPIQESVVSEQPQKDDINKQEEAKDDGHGEASEPISALQAAWNVTNAIQGMFIVGLPIAVKVGGWWSIGAMVGVAYVCYWTGVLLIECLYENGVKKRKTYREIADFYKPGFGKWVLAAQLTELLSTCIIYLVLAADLLQSCFPSVDKAGWMMITSASLLTCSFLDDLQIVSRLSFFNAISHLIVNLIMVLYCLSFVSQWSFSTITFSLNINTLPTIVGMVVFGYTSHIFLPNLEGNMKNPAQFNVMLKWSHIAAAVFKVVFGMLGFLTFGELTQEEISNSLPNQSFKILVNLILVVKALLSYPLPFYAAVQLLKNNLFLGYPQTPFTSCYSPDKSLREWAVTLRIILVLFTLFVALSVPYLVELMGLVGNITGTMLSFIWPALFHLYIKEKTLNNFEKRFDQGIIIMGCSVCISGVYFSSMELLRAINSADS

SEQ ID NO: 38 - DNA, 1527 bp, Mus musculus
cggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaaatggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagttccctggccatcctcatcccccatctgggcatggtccttacccagatgagcttggtgagcagcagcaccctgcccctcatcatcctgtgcctcctggagatgactacctactactcagagtgcatgagctccctcatcatcaccaaggacgccctgatcagcatcctgggctttgtgggatttctggtggggaccttctaggccctccatgagctgatccagcctcaagacctctcctctttccaaactccactggcaccttgaaacagtgaccaattttcaactcaacatttcccgcttcacttcctaaactgacattctagccttgtttgaacaaagatccttctttaaaaaaaaaaaa

SEQ ID NO: 39 - DNA, 644 bp, Mus musculus
gaattcggcttggggaaggcgcatcgtggacttcttcctcatcgtcactcagctgggattctgctgtgtctacttcgtgtttctggcggacaactttaagcaggtgatagaggcagccaatgggaccaccaccaactgcaacaacaatgtgaccgtgatcccgacgcccaccatggactctcgactctacatgctcataagcagttatcaaaaaaaagcagcagaaaatgaggctggaaggagcctggtgtttaccctgttctttggtttgaatcaagccgatgttgaagaagctggaattttttttttatgaataataaaatcccacgtctatatcgtaaagctgtcagtatatgttgaaatcaaggaacgagagaactgccctacagagagtcttaacagccagacagtaccgtgtgctggcgcctacctggatgtgcattgcgtacacgcgtggggcatgtcagagcttcagatgtgcattgcgaacatgcatgggtcatgtcatagcttcagatgtgcattgtgtacatgtgtgggtcatgtcagagcttctaggtctcatttgggttgcacatatggatcttgtgttaaatttccacttcaataaatgaattttattttttatttttgaaaaaaaaaaa

SEQ ID NO: 40 - DNA, 1913 bp, Mus musculus
gaattcggcttggggaaggcgcatcgtggacttcttcctcatcgtcactcagctgggattctgctgtgtctacttcgtgtttctggcggacaactttaagcaggtgatagaggcagccaatgggaccaccaccaactgcaacaacaatgtgaccgtgatcccgacgcccaccatggactctcgactctacatgctctccttcctgcccttcctggtgttgctgtctttcatcaggaacctgcgtgtgttgtccatcttctccctgctggccaacatcagcatgttcgtcagcctgatcatgatataccagttcattgtccagaggatcccagaccccagccacctccccttggtggctccatggaagacctaccctctgttctttggcacagcgatttttgcttttgaaggcattggagtggttctaccccttgagaacaaaatgaaggactcacagaaatttccattgattctgtatttggggatggctatcatcactgtactctacatcagcctggggagcctggggtacctgcaatttggagctaatatcaagggcagcatcaccctcaacctgcccaactgctggttgtaccagtcggtgaagctgctgtactccataggcatcttcttcacctatgccctccagttctatgtcgcagctgagatcatcatcccggccattgtgtcccgagtgcctgagcatttcgagctgatggtggacctttgtgtgcgcaccgccatggtctgtgtgacatttgttattagacgcgttctcacgaccggccaggaagaacaccacagaccagaatcttctgcggcaaagctttattcttacatcttcaggagcagagtgcaagaagcaagagagcaagaagcaagagagagagaaaagcaagagagagagaaaacgaaaccccgtccctttttaaggagaattctccttcgcctcggacgtgtcactccttgattggctgcagcccatcggccgagttgacgtcacggggaaggcagagcacaagtagtcataagatacccttggcacatgcgcagattatttgtttaccacttagaacacagctgtcagcgccatcttgtaacggcgaatgtgggcgcggctcccaacatctccccctatccttttaataagagcaaataggccacccatattaatgagagtggagatagaggtcaaatccccagtgtgtaggtaaaggagccatgtacaggattagctcttaggcttacaggcttttacccagagcaaccctgacctgctcccgtgtcgttttgcctgggggaagggaactaggacactgaaccttcatgaaagatgacatgtctccctagaataggctcatatatgccgcagagcctttccattgcagtgcttagccttgcaactctctcgggctgctgaagcacactcactctatcccgtgcaatgagtctagcctcgtgggatataagagctgagtggccagcgacctattgcctaagcatagatatatcagggaagctccatgttctagtcctgcaagcgcctgggcaataaccaccttgtctctcctagtttgggccttaagcttacagaccaatcaaagaagcaacactaatccacagcaaagtgtatctccaaataatattaatcccacccattttttaaagaaagaaaatgctgaggagatccaattgggtaatcctttggtcagggacaggtccaagcgcgtggagttgacctgaagtctcaattcccgaagggatctgttcaaattcagccatccaattctgtaacatatactgaaaaagactttttgtcaaattagctgtcctagtaaatttaacatactgaatggaaataaaaaaaaaacctatagtgagtcgtattaattcggatccgcgaagccgaattc

SEQ ID NO: 41 - protein, 475 aa, Rattus norvegicus
MSTQRLRNEDYHDYSSTDVSPEESPSEGLGSFSPGSYQRLGENSSMTWFQTLIHLIKGNIGTGLLGLPLAVKNAGLLLGPLSLLVIGIVAVHCMGILVKCAHHLCRRLNKPFLDYGDTVMYGLECSPSTWIRNHSHWGRRIVDFFLVVTQLGFCCVYFVFLADNFKQVIEAANGTTTNCNNNETVILTPTMDSRLYMLTFLPFLVLLSFIRNLRILSIFSLLANISMFVSLIMIYQFIVQRIPDPSHLPLVAPWKTYPLFFGTAIFAFEGIGVVLPLENKMKDSQKFPLILYLGMAIITVLYISLGSLGYLQFGADIKGSITLNLPNCWLYQSVKLLYSIGIFFTYALQFYVAAEIIIPAIVSRVPERFELVVDLSARTAMVCVTCVLAVLIPRLDLVISLVGSVSSSALALIIPPLLEVTTYYGEGISPLTTTKDALISILGFVGFVVGTYESLWELIQPSHSDSSTNSTSAFI

SEQ ID NO: 42 - DNA, 1824 bp, Rattus norvegicus
ggcacgagccggaagcggctgtccaggaggctaaaaaccatggctaggggtcggcgctgaggctgcgcgaggtgggctgagcgggagccagagcgggagcccgagccggagccggagccagagcccgggccgggccgggccgaccgctaccatgtccacacagaggcttcggaacgaagactatcatgactacagttccactgacgtgagccccgaggagagcccatctgaaggcctcgggagcttctcccccggctcctaccagcgcttaggagagaacagtagcatgacatggttccagaccctgatccacctgctaaaaggcaacatcggcaccgggctgctggggctgcctctagcagtgaagaatgcaggcctcttgttgggccctctcagcctgctggtgattggcatcgtggctgtgcactgcatgggcatcctggtgaagtgcgctcatcacttgtgtcggagactgaacaaaccctttctggactatggggacacggtgatgtatggactagaatgcagccccagcacctggattcggaaccactcccactggggaaggcgcatcgtggacttcttcctcgtcgtcactcagctgggtttctgctgcgtctactttgtgtttctggcagacaactttaaacaggtgatagaggcagccaacgggaccaccaccaactgcaacaacaatgagaccgtgatcctaacgcccaccatggactctcgactctacatgctcactttcctgcccttcctggtgctgctgtctttcatcaggaacttgcgtatcttgtccatcttctccctgctggccaacatcagcatgttcgtcagccttatcatgatataccagttcattgtccagaggatcccagaccccagccacctccccttggtggctccatggaagacctaccctctgttctttggcacagcgatttttgctttcgaaggcattggagtggtgctaccccttgagaacaaaatgaaggactcacagaaatttccactgatcctgtatttggggatggctatcatcactgtgctctacatcagcctggggagcctggggtacctgcagtttggagctgatatcaagggcagcatcacactcaacctgcccaactgctggttgtaccagtcggtgaagctgctgtactccataggcatcttcttcacgtatgcgctccagttttatgtcgcagctgagatcatcatcccagccattgtgtcccgagtgcctgaacgtttcgagctggtggtggacctcagtgctcgcactgccatggtctgtgtgacatgtgttctggccgtcctcatcccccgcctggacctggtcatctccctggtgggctctgtgagcagcagcgccctggccctcatcatcccacccctgctggaggtgaccacctactatggagagggcattagtcccctgaccatcaccaaggatgccctcatcagcatcctaggcttcgtgggcttcgtggtggggacctatgagtctctgtgggagctaatccagccaagccatagcgactcctctaccaattccaccagtgccttcatataaggatctgggtgtgctccctttacctgcccagccctaccctgtgtgtctcccagtagtgtcccacatccttaggtgtggctcagcctctggaaaaaggcagggttactgcctgggcactcctctggcattggacccttgggtaacctgggctacatgagacagatgaggggagggcagggagcaccctccacttgtgatggtgcagtcactgctcccctttatcatgcctcctccttcctcgtgcc

SEQ ID NO: 43 - DNA, 372 bp, Mus musculus
aacttgcacctgcacatacacctccttgattgccctctccctaccttgagcttgccctttctgaagccatcatgtctgtgaccaagagtgccaggagtccgcagtagccacccctctcaatctggaccttcctgagagtgccaagaagctgcagaccaggatcccagtccagcgaatgggagctcttcagagtcatcaaagaagaccaagggcataaccgggttccagacattggttcatctggtcaaaggcaacatgggcacagggatcctcggacttcccctggctgtgaagaatgcgggcatcttgatggggcgactcagcttgctggtaatgggcctcatcggctgccactgtatgcacgatctagtc

SEQ ID NO: 44 - protein, 448 aa, Mus musculus
METVQLRNPPRRQLKKLDEDSLTKQPEEVFDVLEKLGEGSYGSVYKAIHKETGQIVAIKQVPVESDLQEIIKEISIMQQCDSPHVVKYYGSYFKNTDLWIVMEYCGASVSDIIRLRNKTLTEDEIATILQSTLKGLEYLHFMRKIHRDIKAGNILLNTEGHAKLADFGVAGQLTDTMAKRNTVIGTPFWMAPEVIQEIGYNCVADIWSLGITAIEMAEGKPPYADIHPMRAIFMIPTNPPPTFRKPELWSDNFTDFVKQCLVKSPEQRATATQLLQHPFVRSAKGVSILRDLINEAMDVKLKRQESQQREMDQDDEENSEEDEMDSGTMVRAVGDEMGTVRVASTMTDGANTMIEHDDTLPSQLGTMVINAEDEEEEGTMKSSLAILIPHLGMVLTQMSLVSSSTLPLIILCLLEMTTYYSECMSSLIITKDALISILGFVGFLVGTF

SEQ ID NO: 45 - DNA, 153 bp, Mus musculus
atgtctgtgaccaagagtgccaggagtccgcaggtagccacccctctcaatctggaccttcctgagagtgccaagaagctgcagagccaggatcccagtccagcgaatgggacctcttcagagtcatcaaagaagaccaagggcataaccggg

SEQ ID NO: 46 - DNA, 117 bp, Mus musculus
agatgtgcccagcgcttctgtcacagactgaacaagcctttcatggactatggggacacagtgatgcacggactggctttcagtcccaatgcctggctgcaaaaccacgcccactgg

SEQ ID NO: 47 - protein, 18 aa, Mus musculus
CGTYQALDELIKSGNSPA

SEQ ID NO: 48 - DNA, 24 bp, Artificial Sequence
  Synthetic
tgccaaaggagtgtcaatactgcg

SEQ ID NO: 49 - DNA, 24 bp, Artificial Sequence
  Synthetic
tccccaccagaaatcccacaaagc

SEQ ID NO: 50 - DNA, 986 bp, Mus musculus
gaattcggcacgaggcaaccatcagctgcccaagaacgagacggtagttctgacgcccaccatggactctcgactctacatgctctccttcctgcccgttctggggcttctggtgttcgtcaggaacctgcgtgtcctcaccatcttctccctgctggccaacatcagcatgctggtcagcctggtcatcattgcccagtacatcatccaggaaattccagatgccagccagttgccactggtagcaagctggaagacctacccgctcttctttggaacagccattttttcatttgaaagcatcggtgtggtcctgcctctggaaaacaagatgaaggatgcccgcggcttcccaaccattctgtctttggggatgtccatcatcaccaccctgtacattgctatcggggctctgggctacctgcggtttggagatgacatcaaagccagcatcactcttaacctgcccaactgctggctgtaccaatcagtcaagctcctgtatgtcgtcggtatcctgtgtacctatgccctgcagttctacgtccctgcggaaatcatcacccccttgctgtctcccaggtgtcaaaacgctgggcactgcccgtggacctgtctatccggcttgccctggtctgcctcacatgcatgctggccatcctcatcccacgcctggacctggtcctctccctggtgggctctgtgagcagcagcgccctggccctcatcatcccgcccctgctggaggtggtcacctactatggagagggcattagccccctgaccgtcaccaaggatgccctcatcagcatcctgggcttcatgggctttgtggtggggacctaccaggccctggatgagctgatcaagtccgggaactctcccgccctgtccaactccaccatgtttattcagtgacagagcctctcctcgcccacggtgaaaaaaaaaaaaaaaaaaaaaaaaccattgcgggccgcaagctt

SEQ ID NO: 51 - skipped
  Intentionally omitted sequence.

SEQ ID NO: 52 - skipped
  Intentionally omitted sequence.

SEQ ID NO: 53 - DNA, 29 bp, Rattus norvegicus
gacttcccctggctgtgaagaatgcgggc

SEQ ID NO: 54 - DNA, 32 bp, Rattus norvegicus
tcagtctgtgacagaagcgctgggcacatctg

SEQ ID NO: 55 - DNA, 2436 bp, Rattus norvegicus; identical to SEQ ID NO: 6

SEQ ID NO: 56 - skipped
  Intentionally omitted sequence.

SEQ ID NO: 57 - protein, 4 aa, Artificial Sequence
  Synthetic
DEMD

SEQ ID NO: 58 - DNA, 20 bp, Artificial Sequence
  Synthetic
gctgccacaagaacgagacg

SEQ ID NO: 59 - DNA, 21 bp, Artificial Sequence
  Synthetic
atgatgaccaggctgaccagc

SEQ ID NO: 60 - skipped
  Intentionally omitted sequence.

SEQ ID NO: 61 - DNA, 24 bp, Artificial Sequence
  Synthetic
aggctgtgcggacagtcaggtcta

SEQ ID NO: 62 - DNA, 28 bp, Artificial Sequence
  Synthetic
agacgacataggggacgatgatctcagc

SEQ ID NO: 63 - DNA, 24 bp, Artificial Sequence
  Synthetic
gctgtaccagtcagtcaagctgat

SEQ ID NO: 64 - DNA, 26 bp, Artificial Sequence
  Synthetic
cagcagggagaagatggacaacacac

SEQ ID NO: 65 - DNA, 29 bp, Artificial Sequence
  Synthetic
agctgagtgacgatgaggaagaagtccac

SEQ ID NO: 66 - DNA, 23 bp, Artificial Sequence
  Synthetic
ctatggggacacggtgatgtatg

SEQ ID NO: 67 - DNA, 19 bp, Artificial Sequence
  Synthetic
ggggaaggcgcatcgtgga

SEQ ID NO: 68 - DNA, 22 bp, Artificial Sequence
  Synthetic
cctctcagcctgctggtgattg

SEQ ID NO: 69 - DNA, 24 bp, Artificial Sequence
  Synthetic
ggacactactgggagacacacagg

SEQ ID NO: 70 - DNA, 10 bp, Artificial Sequence
  Synthetic
gaattcggct

SEQ ID NO: 71 - DNA, 458 bp, Mus musculus
taatacgactcactatagggcgaattggagctccaccgcggtggcggccgctctagaactagtggatcccccgggctgcaggaattcggcttccactcaaggcaggaaattagcagataaatgacaaaaacaagatggcggtttccacaggtgaggtctccacagtgtggaaaactagagaacgaccaacatttcttttgtttttaatgaccatctatctacaccttgtatgcggtgtagatggcccccatctcctttgcgcgcgcgcgcacacacacacggtactggggatatgctacacctgttttttgttttgttttgttttttcctgtcttggaccagagaaaaggcaaagtgaaaaaattcatagacaacataagtcaccgtgggcgaggagaggctctgtcactgaataaacatggtggagttggacagaagccgaattcgatatcaagctt

SEQ ID NO: 72 - DNA, 478 bp, Mus musculus
taatacgactcactatagggcgaattgggccctctagatgcatgctcgagcggccgccagtgtgatggatatctgcagaattcggcttgaggtactgctgctgcttctgctgttgctgctgccttttgaggaggctgtagaccgaccgaacatattccgctgacacttgccaacttctctaagcagcggcacattccccatgatggacaggcagcaggggtatagcactcagctgccgcaggctctcagtgggctttcatcaggagaagccatacagcaggtctcaggttctggctcctgactcctgggtatgcctggccacagactttcagcctctcccagatcagtccttgatgctgtggtccacggggaacactgaccaaggaggaggaaggtatcattagaccggaagttctggtgcctagctgtgggctttaagccgaattccagcacactggcggccgttactagtggatcc

SEQ ID NO: 73 - DNA, 454 bp, Mus musculus
taatacgactcactatagggcgaattgggccctctagatgcatgctcgagcggccgccagtgtgatggatatctgcagaattcggcttatggaagtccacagaagcatggggcttccagaggcggtgcatgctcacatgatctgcttgaggtctctgagccagctgggagtggcagctcatgctagtaacctccatacttgaggcaacggtaggagaactgagagcccatcgtcatccttgactacacagcaagcaagttcaaagccaactctggtgacatgagaccctgtctgaggatgtggggacactactgggagacacacagggtgaggctggtggagggagcacacccagatccttatatgaaggcactggtggaattggtagaggagtcgctatggcttggctggaaagccgaattccagcacactggcggccgttactagtggatcc

SEQ ID NO: 74 - protein, 19 aa, Artificial Sequence
  Synthetic
ESAKKLQSQDPSPANGTSC

SEQ ID NO: 75 - DNA, 18 bp, Mus musculus
gccatcatgttggtcctg

SEQ ID NO: 76 - DNA, 18 bp, Mus musculus
  misc_feature (4)..(4): n at this position can be a or g.
gccnccatggtggtaagg

The invention claimed is:

1. A method for identifying nucleic acids encoding proteins which bind a mouse tramd 1 protein encoded by a nucleic acid selected from the group consisting of SEQ ID NO: 7, SEQ ID NO: 13, SEQ ID NO: 45 and SEQ ID NO: 46, said method comprising:
   (a) providing:
      (i) a first recombinant vector comprising a nucleic acid sequence selected from the group consisting of SEQ ID NO: 7, SEQ ID NO: 13, SEQ ID NO: 45, and SEQ ID NO: 46 in operable combination with the DNA binding domain of a transcriptional activator, such that a chimeric protein will be expressed,
      (ii) a population of second recombinant vectors, wherein said population comprises a library of cDNA molecules in operable combination with the activation domain of a transcriptional activator, such that a population of chimeric proteins will be expressed, and
      (iii) a yeast host comprising a reporter gene in operable combination with the DNA binding sites for said transcriptional activator;
   (b) introducing said first vector and said population of second vectors into said yeast host to generate a population of transformed yeast;
   (c) subjecting said population of transformed yeast to conditions such that said chimeric proteins are expressed;
   (d) screening said population for members which express said reporter gene; and
   (e) isolating the cDNA molecule from said second vector from members of the population which express the reporter gene, thereby identifying nucleic acids encoding proteins which bind a mouse tramd 1 protein.

* * * * *